US011291693B2

(12) United States Patent
Falb et al.

(10) Patent No.: US 11,291,693 B2
(45) Date of Patent: Apr. 5, 2022

(54) BACTERIA ENGINEERED TO TREAT METABOLIC DISEASES

(71) Applicant: Synlogic Operating Company, Inc., Cambridge, MA (US)

(72) Inventors: Dean Falb, Sherborn, MA (US); Vincent M. Isabella, Medford, MA (US); Jonathan W. Kotula, Berkeley, CA (US); Paul F. Miller, Salem, CT (US); Sarah Rowe, Durham, NC (US); Yves Millet, Newton, MA (US); Adam Fisher, Cambridge, MA (US)

(73) Assignee: Synlogic Operating Company, Inc., Cambridge, MA (US)

( * ) Notice: Subject to any disclaimer, the term of this patent is extended or adjusted under 35 U.S.C. 154(b) by 28 days.

(21) Appl. No.: 15/738,174

(22) PCT Filed: Jun. 24, 2016

(86) PCT No.: PCT/US2016/039444
§ 371 (c)(1),
(2) Date: Dec. 20, 2017

(87) PCT Pub. No.: WO2016/210384
PCT Pub. Date: Dec. 29, 2016

(65) Prior Publication Data
US 2019/0298779 A1    Oct. 3, 2019

Related U.S. Application Data

(63) Continuation-in-part of application No. PCT/US2016/032565, filed on May 13, 2016.
(Continued)

(51) Int. Cl.
*A61K 35/74* (2015.01)
*A23L 33/135* (2016.01)
(Continued)

(52) U.S. Cl.
CPC ............ *A61K 35/74* (2013.01); *A23L 33/135* (2016.08); *A61K 9/0053* (2013.01);
(Continued)

(58) Field of Classification Search
CPC ...... C12N 9/001; C12N 15/70; Y02A 50/401; C12Y 103/08001; C12Y 207/02007;
(Continued)

(56) References Cited

U.S. PATENT DOCUMENTS 5,039,703 A    8/1991 Breuer
5,776,753 A    7/1998 Hillman et al.
(Continued)

FOREIGN PATENT DOCUMENTS

CN    101948857 A    1/2011
CN    102220276 A    10/2011
(Continued)

OTHER PUBLICATIONS

Vital et al., (mbio 5(2):e00889-14. Published Apr. 2014) (Year: 2014).*
(Continued)

*Primary Examiner* — Jana A Hines
(74) *Attorney, Agent, or Firm* — McCarter & English, LLP; Marcie B. Clarke

(57) ABSTRACT

Genetically engineered bacteria, pharmaceutical compositions thereof, and methods of attenuating metabolic diseases are disclosed.

19 Claims, 103 Drawing Sheets

Specification includes a Sequence Listing.

Related U.S. Application Data

(60) Provisional application No. 62/354,682, filed on Jun. 24, 2016, provisional application No. 62/354,681, filed on Jun. 24, 2016, provisional application No. 62/348,620, filed on Jun. 10, 2016, provisional application No. 62/348,416, filed on Jun. 10, 2016, provisional application No. 62/347,576, filed on Jun. 8, 2016, provisional application No. 62/347,554, filed on Jun. 8, 2016, provisional application No. 62/347,508, filed on Jun. 8, 2016, provisional application No. 62/336,012, filed on May 13, 2016, provisional application No. 62/293,695, filed on Feb. 10, 2016, provisional application No. 62/277,346, filed on Jan. 11, 2016, provisional application No. 62/184,777, filed on Jun. 25, 2015.

(51) Int. Cl.

| | | |
|---|---|---|
| A61P 3/10 | (2006.01) | |
| A61K 9/00 | (2006.01) | |
| A61K 35/741 | (2015.01) | |
| C12N 15/52 | (2006.01) | |
| A61K 35/747 | (2015.01) | |
| A61K 35/744 | (2015.01) | |
| A61K 35/745 | (2015.01) | |
| A61K 35/00 | (2006.01) | |

(52) U.S. Cl.
CPC .......... *A61K 35/741* (2013.01); *A61K 35/744* (2013.01); *A61K 35/745* (2013.01); *A61K 35/747* (2013.01); *A61P 3/10* (2018.01); *C12N 15/52* (2013.01); *A23V 2002/00* (2013.01); *A61K 9/0031* (2013.01); *A61K 2035/115* (2013.01); *Y02A 50/30* (2018.01)

(58) Field of Classification Search
CPC ............ A61K 35/741; A61K 2035/115; A61K 38/20; A61K 38/2013; A61K 38/2066; A61K 38/26; A61K 38/446
See application file for complete search history.

(56) References Cited

U.S. PATENT DOCUMENTS

| | | | |
|---|---|---|---|
| 6,605,709 | B1 | 8/2003 | Breton |
| 6,610,836 | B1 | 8/2003 | Breton et al. |
| 7,041,814 | B1 | 5/2006 | Weinstock et al. |
| 7,262,037 | B2 | 8/2007 | Chen et al. |
| 7,541,173 | B2 | 6/2009 | Bramucci et al. |
| 7,608,265 | B2 | 10/2009 | Burnie et al. |
| 2,129,785 | A1* | 12/2009 | Hu et al. ............... C12P 7/6409 |
| 7,939,061 | B2 | 5/2011 | Prakash et al. |
| 8,129,169 | B2 | 3/2012 | Van Dien et al. |
| 8,470,885 | B2 | 6/2013 | Szewczyk |
| 8,758,764 | B2 | 6/2014 | Masignani et al. |
| 8,932,578 | B2 | 1/2015 | Prakash et al. |
| 9,096,873 | B2 | 8/2015 | Wu et al. |
| 9,668,991 | B1 | 6/2017 | Cahan |
| 9,688,967 | B2 | 6/2017 | Falb et al. |
| 9,738,875 | B2 | 8/2017 | Koepke et al. |
| 9,801,933 | B2 | 10/2017 | Honda et al. |
| 9,816,111 | B2 | 11/2017 | Silverman et al. |
| 2003/0235588 | A1 | 12/2003 | Richon et al. |
| 2014/0273110 | A1 | 9/2014 | Gonzalez et al. |
| 2016/0177274 | A1* | 6/2016 | Falb .......................... C12R 1/19 424/93.2 |
| 2017/0042860 | A1 | 2/2017 | Kashyap et al. |
| 2017/0067065 | A1* | 3/2017 | Falb ....................... A61K 38/20 |
| 2017/0087196 | A1 | 3/2017 | Pamer et al. |
| 2017/0088862 | A1 | 3/2017 | Gonzalez et al. |
| 2017/0216415 | A1 | 8/2017 | Bermudez-Humaran et al. |
| 2019/0010506 | A1 | 1/2019 | Falb et al. |

FOREIGN PATENT DOCUMENTS

| | | |
|---|---|---|
| CN | 104087606 A | 10/2014 |
| CN | 106754115 A | 5/2017 |
| CN | 106755003 A | 5/2017 |
| EP | 2344626 B1 | 7/2011 |
| EP | 2615163 A1 | 7/2013 |
| WO | 1993/05161 A1 | 3/1993 |
| WO | 2008/119082 A2 | 10/2008 |
| WO | 2016/183532 A1 | 11/2016 |
| WO | 2016/210373 A2 | 12/2016 |
| WO | 2016/210384 A2 | 12/2016 |
| WO | 2017/074566 A1 | 5/2017 |
| WO | 2017/136792 A2 | 8/2017 |

OTHER PUBLICATIONS

Lambea et al., ( Current Opinion in Biotech. vol. 35, Dec. 2015, pp. 94-102. Epub Jun. 2015) (Year: 2015).*
Le Barz et al., (Diabetes Metab J. Aug. 2015:39(4):291-303). (Year: 2015).*
Mandell et al., (Nature. Feb. 2015 518(7537):55-60 epub Jan. 21, 2015). (Year: 2015).*
Aboulnaga et al., Effect of an oxygen-tolerant bifurcating butyryl coenzyme A dehydrogenase/electron-transferring flavoprotein complex from Clostridium difficile on butyrate production in *Escherichia coli*. J Bacteriol. Aug. 2013;195 (16):3704-13.
Baek et al., Butyrate production in engineered *Escherichia coli* with synthetic scaffolds. Biotechnol Bioeng. Oct. 2013;110(10):2790-4.
Becker et al., O2 as the regulatory signal for FNR-dependent gene regulation in *Escherichia coli*. J Bacteriol. Aug. 1996;178(15):4515-21.
Braat et al., A phase I trial with transgenic bacteria expressing interleukin-10 in Crohn's disease. Clin Gastroenterol Hepatol. Jun. 2006;4(6):754-9.
Castagiuolo et al., Engineered *E. coli* delivers therapeutic genes to the colonic mucosa. Gene Ther. Jul. 2005;12 (13):1070-8.
Dumesny et al., Synthesis, expression and biological activity of the prohormone for gastrin releasing peptide (ProGRP). Endocrinology. Jan. 2006;147(1):502-9.
Dwidar et al., The future of butyric acid in industry. ScientificWorldJournal. 2012;2012:471417. 9 pages.
Guarner et al., Gut flora in health and disease. Lancet. Feb. 8, 2003;361(9356):512-9.
Han et al., Kynurenine aminotransferase and glutamine transaminase K of *Escherichia coli*: identity with aspartate aminotransferase. Biochem J. Dec. 15, 2001;360(Pt 3):617-23.
Huibregtse et al., Genetically Modified Lactococcus lactis for Delivery of Human Interleukin-10 to Dendritic Cells. Gastroenterol Res Pract. 2012;2012:639291. 8 pages.
Jayashree et al., Identification and characterization of bile salt hydrolase genes from the genome of Lactobacillus fermentum MTCC 8711. Appl Biochem Biotechnol. Sep. 2014;174(2):855-66.
Kim et al., Cloning and characterization of the bile salt hydrolase genes (bsh) from Bifidobacterium bifidum strains. Appl Environ Microbiol. Sep. 2004;70(9):5603-12.
Kumar et al., Molecular cloning, characterization and heterologous expression of bile salt hydrolase (Bsh) from Lactobacillus fermentum NCD0394. Mol Biol Rep. Aug. 2013;40(8):5057-66.
Lim et al., Refactoring redox cofactor regeneration for high-yield biocatalysis of glucose to butyric acid in *Escherichia coli*. Bioresour Technol. May 2013;135:568-73.
Liu et al., A novel genetically engineered pathway for synthesis of poly(hydroxyalkanoic acids) in *Escherichia coli*. Appl Environ Microbiol. Feb. 2000;66(2):739-43.
Mangesha et al., Development of a flexible and potent hypoxia-inducible promoter for tumor-targeted gene expression in attenuated *Salmonella*. Cancer Biol Ther. Sep. 2006;5(9):1120-8.
Romasi et al., Development of indole-3-acetic acid-producing *Escherichia coli* by functional expression of IpdC, AspC, and Iad1. J Microbiol Biotechnol. Dec. 2013;23(12):1726-36.

(56) References Cited

OTHER PUBLICATIONS

Saini et al., Metabolic engineering of *Escherichia coli* for production of butyric acid. J Agric Food Chem. May 14, 2014;62(19):4342-8.
Sarsero et al., A new family of integral membrane proteins involved in transport of aromatic amino acids in *Escherichia coli*. J Bacteriol. May 1991;173(10):3231-4.
Sleator et al., Rational design of improved pharmabiotics. J Biomed Biotechnol. 2009;2009:275287. 7 pages.
Steidler et al., Biological containment of genetically modified Lactococcus lactis for intestinal delivery of human interleukin 10. Nat Biotechnol. Jul. 2003;21(7):785-9.
Steidler, Genetically engineered probiotics. Best Pract Res Clin Gastroenterol. Oct. 2003;17(5):861-76.
Strauch et al., Oxygen regulation in *Salmonella typhimurium*. J Bacteriol. Feb. 1985;161(2):673-80.
Unden et al., Control of FNR function of *Escherichia coli* by O2 and reducing conditions. J Mol Microbiol Biotechnol. May 2002;4(3):263-8.
Vital et al., Revealing the bacterial butyrate synthesis pathways by analyzing (meta)genomic data. MBio. Apr. 22, 2014;5(2):e00889. 11 pages.
Volker et al., Fermentative production of short-chain fatty acids in *Escherichia coli*. Microbiology. Jul. 2014;160(Pt 7):1513-22.
Wang et al., Expression of rat pro cholecystokinin (CCK) in bacteria and in insect cells infected with recombinant baculovirus. Peptides. 1997;18(9):1295-9.
Whelan et al., A transgenic probiotic secreting a parasite immunomodulator for site-directed treatment of gut inflammation. Mol Ther. Oct. 2014;22(10):1730-40.
Zhang et al., Low temperature and glucose enhanced T7 RNA polymerase-based plasmid stability for increasing expression of glucagon-like peptide-2 in *Escherichia coli*. Protein Expr Purif. May 2003;29(1):132-9.
International Search Report for Application No. PCT/US2016/039444, dated Jan. 30, 2017. 13 pages.
Akawi et al., Engineering *Escherichia coli* for high-level production of propionate. J Ind Microbiol Biotechnol. Jul. 2015;42(7):1057-72.
Bindels et al., Gut microbiota-derived propionate reduces cancer cell proliferation in the liver. Br J Cancer. Oct. 9, 2012;107(8):1337-44.
Callura et al., Tracking, tuning, and terminating microbial physiology using synthetic riboregulators. Proc Natl Acad Sci U S A. Sep. 7, 2010;107(36):15898-903.
Forster et al., Metabolic Engineering of *Escherichia coli* for Production of Mixed-Acid Fermentation End Products. Front Bioeng Biotechnol. May 23, 2014;2:16. pp. 1-12.
Gardlik et al., Recombinant probiotic therapy in experimental colitis in mice. Folia Biol (Praha). 2012;58(6):238-45.
Kelly et al., Crosstalk between Microbiota-Derived Short-Chain Fatty Acids and Intestinal Epithelial HIF Augments Tissue Barrier Function. Cell Host Microbe. May 13, 2015;17(5):662-71.
Patel et al., Probiotic bile salt hydrolase: current developments and perspectives. Appl Biochem Biotechnol. Sep. 2010;162(1):166-80.
Rajagopal et al., Use of inducible feedback-resistant N-acetylglutamate synthetase (argA) genes for enhanced arginine biosynthesis by genetically engineered *Escherichia coli* K-12 strains. Appl Environ Microbiol. May 1998;64 (5):1805-11.
Seo et al., Construction of recombinant *E. coli* Nissle 1917 (EcN) strains for the expression and secretion of defensins. Int J Med Microbiol. Nov. 2012;302(6):276-87.
Yadav et al., Beneficial metabolic effects of a probiotic via butyrate-induced GLP-1 hormone secretion. J Biol Chem. Aug. 30, 2013;288(35):25088-97.
Asgharpour et al., A diet-induced animal model of non-alcoholic fatty liver disease and hepatocellular cancer. J Hepatol. Sep. 2016;65(3):579-88.
Buffie et al., Precision microbiome reconstitution restores bile acid mediated resistance to Clostridium difficile. Nature. Jan. 8, 2015;517(7533):205-8.

Fujii et al., A murine model for non-alcoholic steatohepatitis showing evidence of association between diabetes and hepatocellular carcinoma. Med Mol Morphol. Sep. 2013;46(3):141-52.
Ho et al., Obeticholic acid, a synthetic bile acid agonist of the farnesoid X receptor, attenuates experimental autoimmune encephalomyelitis. Proc Natl Acad Sci U S A. Feb. 9, 2016;113(6):1600-5.
Hull et al., *Arabidopsis* cytochrome P450s that catalyze the first step of tryptophan-dependent indole-3-acetic acid biosynthesis. Proc Natl Acad Sci U S A. Feb. 29, 2000;97(5):2379-84.
Jones et al., Cholesterol lowering with bile salt hydrolase-active probiotic bacteria, mechanism of action, clinical evidence, and future direction for heart health applications. Expert Opin Biol Ther. May 2013;13(5):631-42.
Joyce et al., Regulation of host weight gain and lipid metabolism by bacterial bile acid modification in the gut. Proc Natl Acad Sci U S A. May 20, 2014;111(20):7421-6.
Kanuri et al., In vitro and in vivo models of non-alcoholic fatty liver disease (NAFLD). Int J Mol Sci. Jun. 5, 2013;14 (6):11963-80.
Khalid et al., Non-Alcoholic Fatty Liver Disease: The Effect of Bile Acids and Farnesoid X Receptor Agonists on Pathophysiology and Treatment. Liver Res Open J. 2015;1(2):32-40.
Kim et al., l-Tryptophan exhibits therapeutic function in a porcine model of dextran sodium sulfate (DSS)-induced colitis. J Nutr Biochem. Jun. 2010;21(6):468-75.
Macia et al., Metabolite-sensing receptors GPR43 and GPR109A facilitate dietary fibre-induced gut homeostasis through regulation of the inflammasome. Nat Commun. Apr. 1, 2015;6:6734. 15 pages.
Matsumoto et al., An improved mouse model that rapidly develops fibrosis in non-alcoholic steatohepatitis. Int J Exp Pathol. Apr. 2013;94(2):93-103.
Mikkelsen et al., Cytochrome P450 CYP79B2 from *Arabidopsis* catalyzes the conversion of tryptophan to indole-3-acetaldoxime, a precursor of indole glucosinolates and indole-3-acetic acid. J Biol Chem. Oct. 27, 2000;275 (43):33712-7.
Nafisi et al., *Arabidopsis* cytochrome P450 monooxygenase 71A13 catalyzes the conversion of indole-3-acetaldoxime in camalexin synthesis. Plant Cell. Jun. 2007;19(6):2039-52.
Nakagawa, Recent advances in mouse models of obesity- and nonalcoholic steatohepatitis-associated hepatocarcinogenesis. World J Hepatol. Aug. 18, 2015;7(17):2110-8.
Naur et al., CYP79B1 from Sinapis alba converts tryptophan to indole-3-acetaldoxime. Arch Biochem Biophys. Jan. 1, 2003;409(1):235-41.
Neuschwander-Tetri et al., Farnesoid X nuclear receptor ligand obeticholic acid for non-cirrhotic, non-alcoholic steatohepatitis (FLINT): a multicentre, randomised, placebo-controlled trial. Lancet. Mar. 14, 2015;385(9972):956-65.
Park et al., Production of serotonin by dual expression of tryptophan decarboxylase and tryptamine 5-hydroxylase in *Escherichia coli*. Appl Microbiol Biotechnol. Mar. 2011;89(5):1387-94.
Sanches et al., Nonalcoholic Steatohepatitis: A Search for Factual Animal Models. Biomed Res Int. 2015;2015:574832. 14 pages.
Shen et al., Improved production of tryptophan in genetically engineered *Escherichia coli* with TktA and PpsA overexpression. J Biomed Biotechnol. 2012;2012:605219, 8 pages.
Takamura et al., Lactobacillus bulgaric OLL1181 activates the aryl hydrocarbon receptor pathway and inhibits colitis. Immunol Cell Biol. Oct. 2011;89(7):817-22.
Thomas, NAFLD: Blocking ileal bile acid uptake safeguards against NAFLD. Nat Rev Gastroenterol Hepatol. Nov. 2016;13(11):623.
Wiest et al., Targeting the gut-liver axis in liver disease. J Hepatol. Nov. 2017;67(5):1084-1103.
Williams et al., Discovery and characterization of gut microbiota decarboxylases that can produce the neurotransmitter tryptamine. Cell Host Microbe. Oct. 8, 2014;16(4):495-503.
Zelante et al., Tryptophan catabolites from microbiota engage aryl hydrocarbon receptor and balance mucosal reactivity via interleukin-22. Immunity. Aug. 22, 2013;39(2):372-85.
U.S. Appl. No. 16/069,266, filed Jul. 11, 2018, 2019-0010506, Published.
Cheng et al., Aryl Hydrocarbon Receptor Activity of Tryptophan Metabolites in Young Adult Mouse Colonocytes. Drug Metab Dispos. Oct. 2015;43(10): 1536-43.

(56) References Cited

OTHER PUBLICATIONS

Jadaun et al., Withania coagulans tryptophan decarboxylase gene cloning, heterologous expression, and catalytic characteristics of the recombinant enzyme. Protoplasma. Jan. 2017;254(1):181-192.

Kochar et al., Indole-3-acetic acid biosynthesis in the biocontrol strain Pseudomonas fluorescens Psd and plant growth regulation by hormone overexpression. Res Microbiol. May 2011;162(4):426-35.

Lamas et al., CARD9 impacts colitis by altering gut microbiota metabolism of tryptophan into aryl hydrocarbon Yeceptor ligands. Nat Med. Jun. 2016;22(6):598-605.

Li et al., Molecular Cloning and Characterization of Two Genes Encoding Tryptophan Decarboxylase from Aegilops variabilis with Resistance to the Cereal Cyst Nematode (Heterodera avenae) and Root-Knot Nematode (Meloidogyne naasi). Plant Mol Biol Rep. 2016;34:273-282.

Malhotra et al., Targeted engineering of Azospirillum brasilense SM with indole acetamide pathway for indoleacetic acid overexpression. Can J Microbiol. Nov. 2006;52(11):1078-84.

Park et al., Conversion of 5-hydroxytryptophan into serotonin by tryptophan decarboxylase in plants, Escherichia coli, and yeast. Biosci Biotechnol Biochem. Sep. 2008;72(9):2456-8.

* cited by examiner

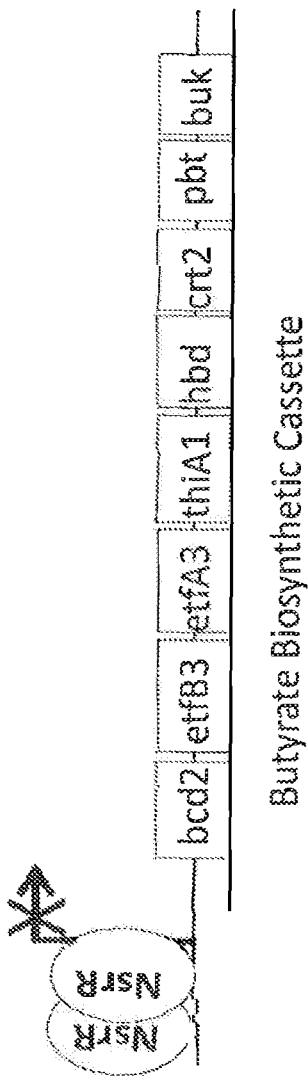
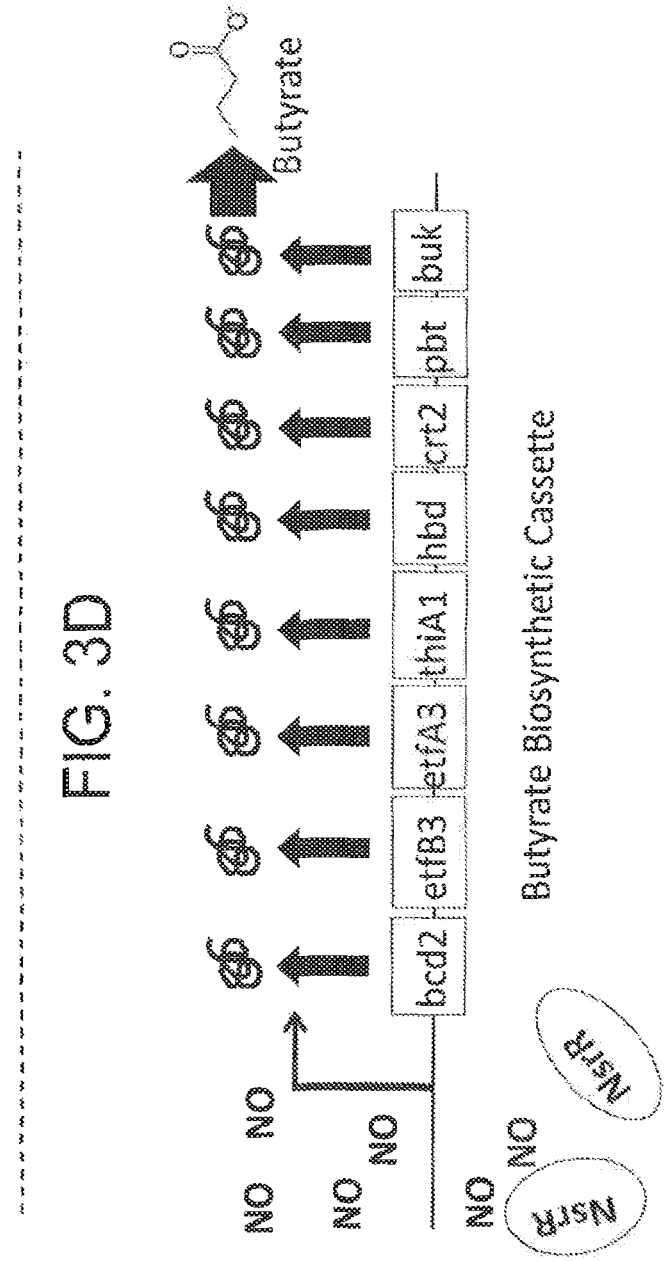
FIG. 3C
FIG. 3D

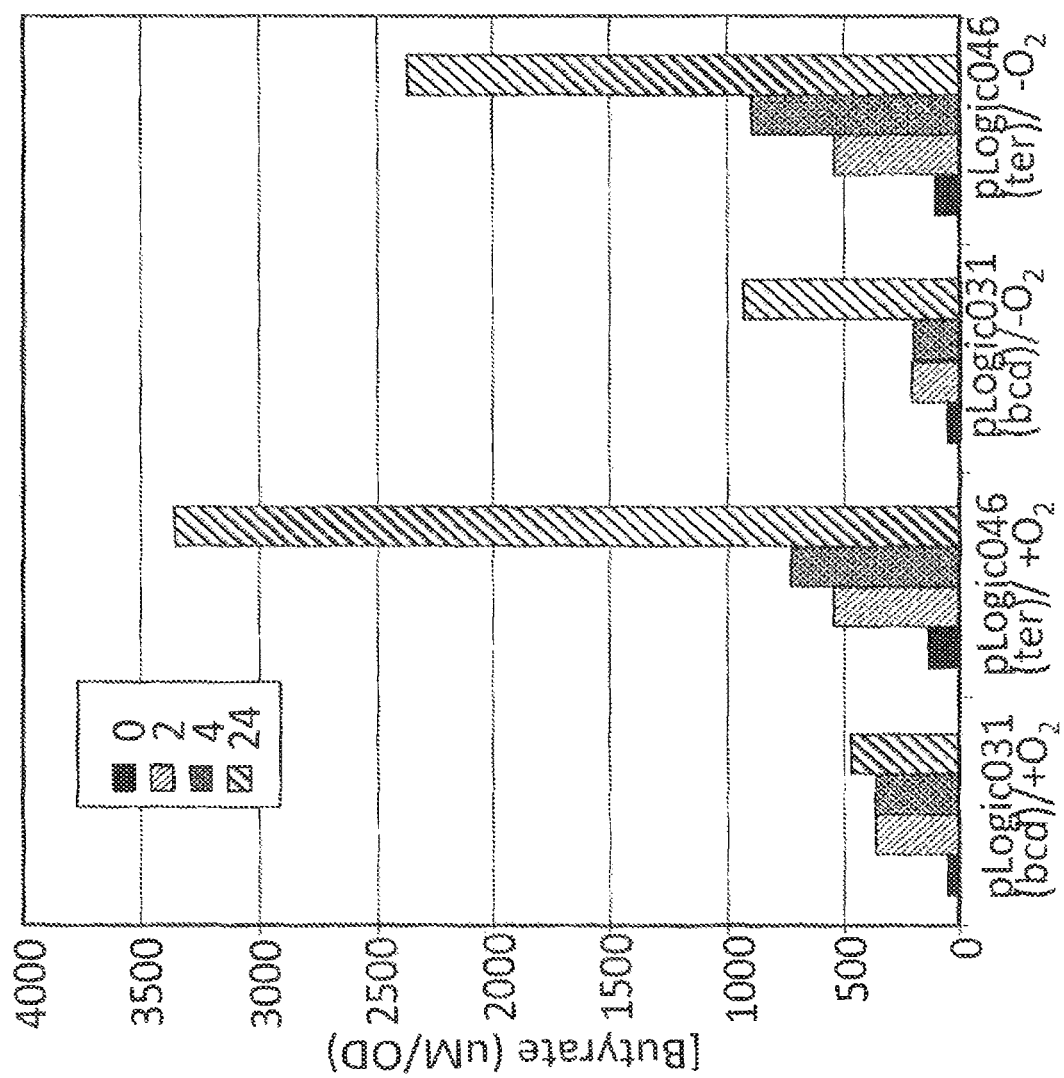

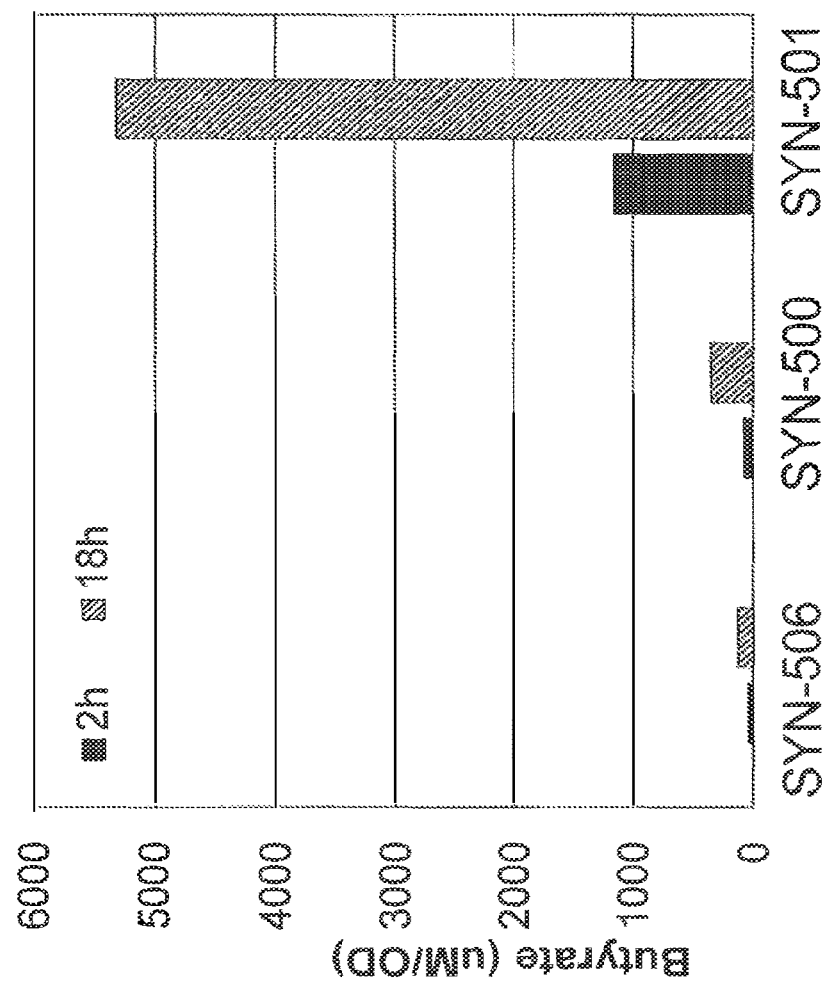

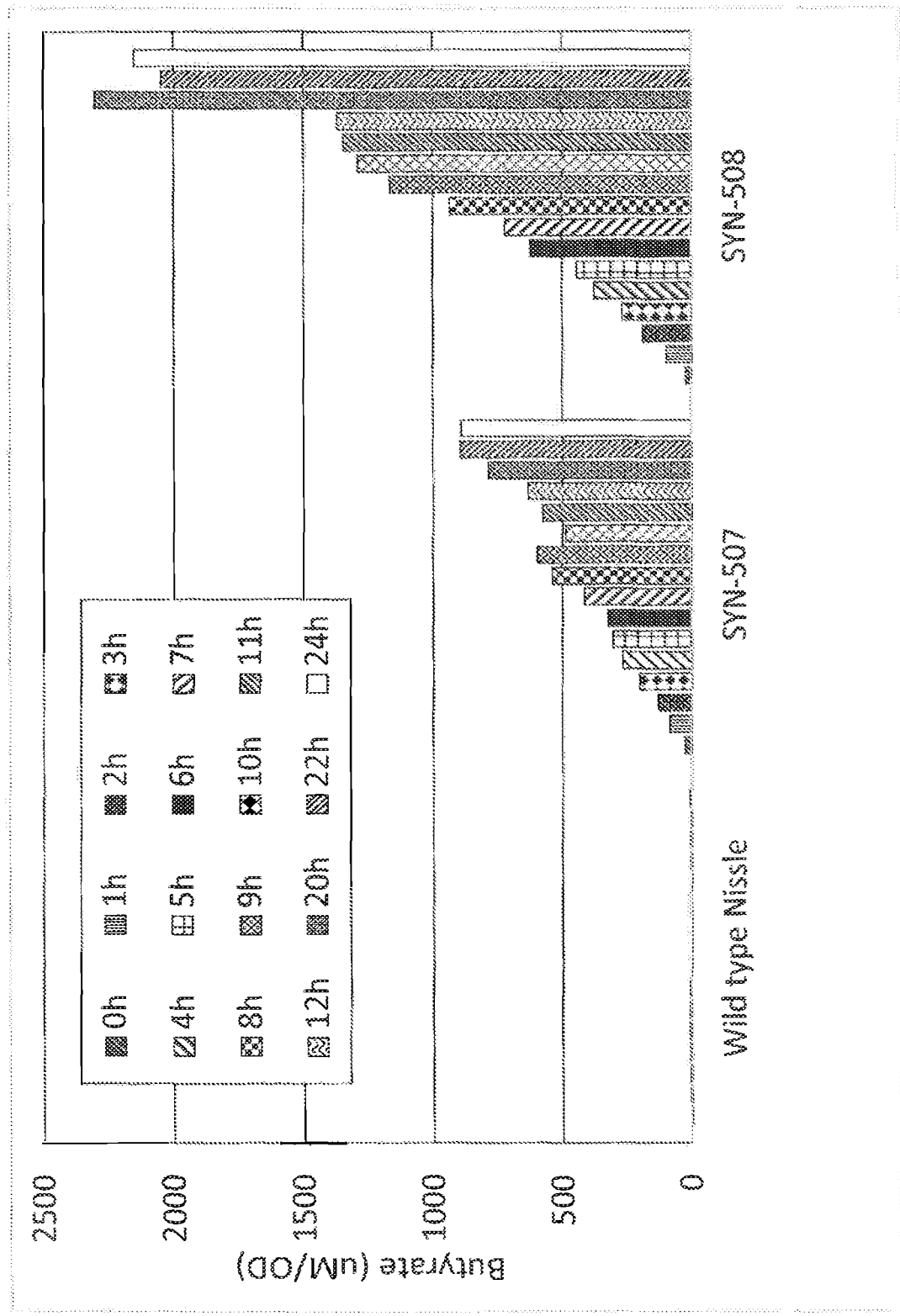

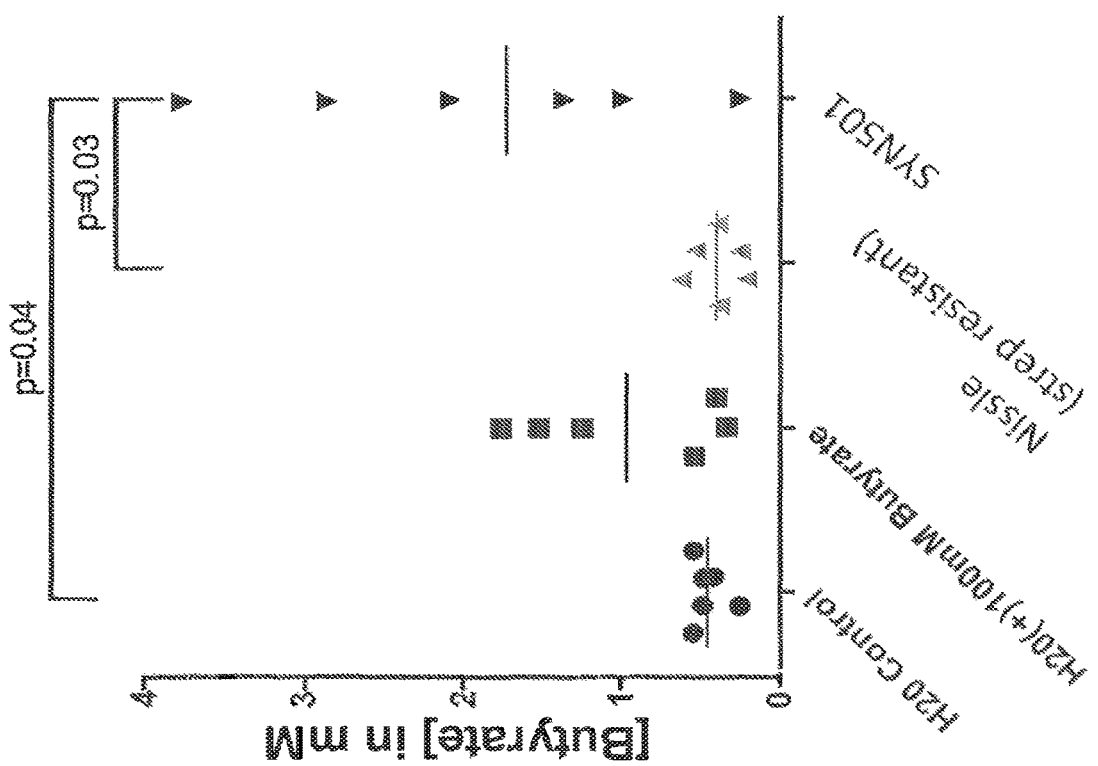

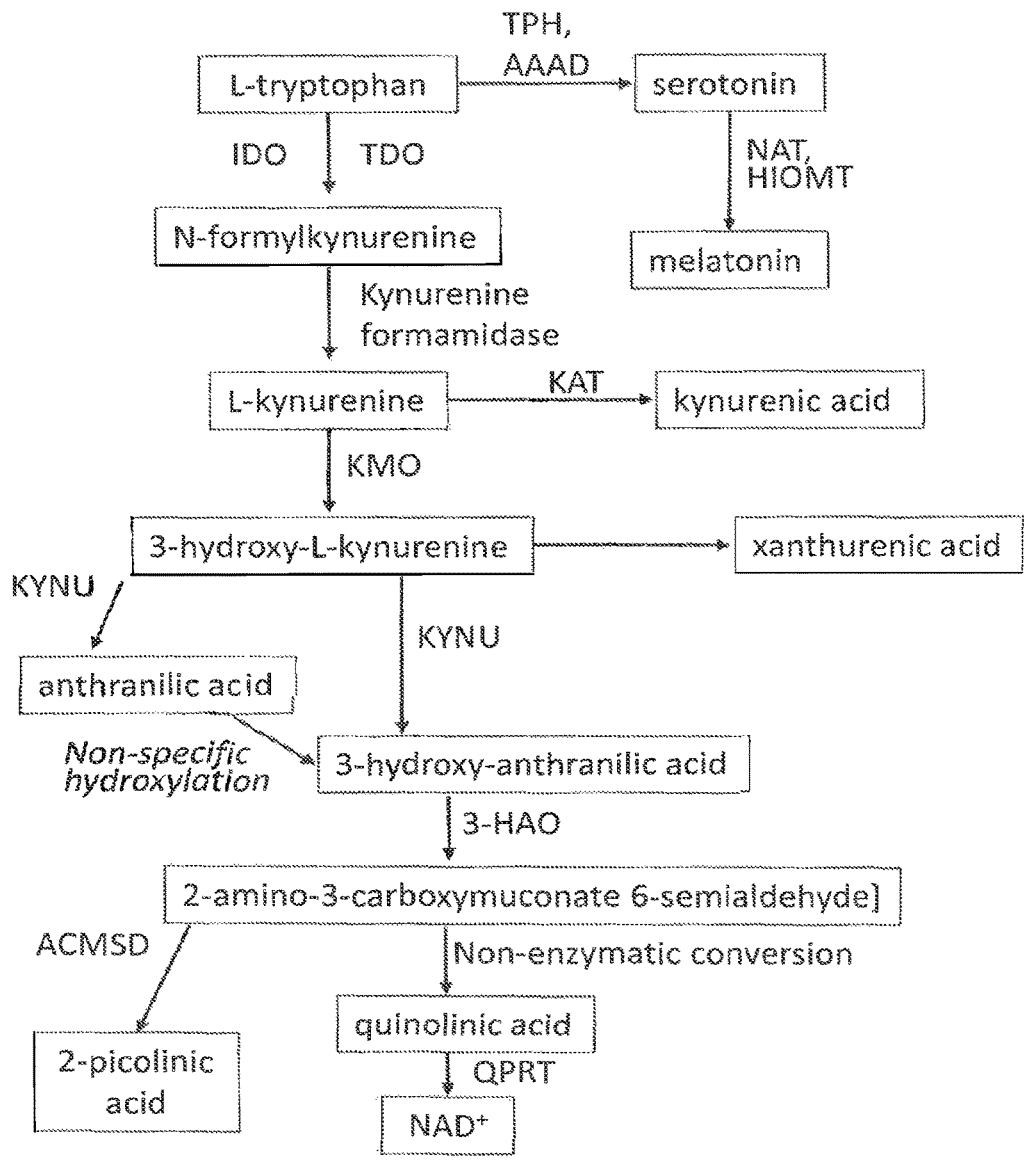

3-HAO: 3-hydroxyl-anthranilate 3,4-dioxidase; AAAD: aromatic-amino acid decarboxylase; ACMSD, alpha-amino-beta-carboxymuconate-epsilon-semialdehyde decarboxylase; HIOMT, hydroxyl-O-methyltransferase; IDO, indoleamine 2,3-dioxygenase; KAT, kynurenine amino transferases I-III; KMO: kynurenine 3-monooxygenase; KYNU, kynureninase; NAT, N-acetyltransferase; TDO, tryptophan 2,3-dioxygenase; TPH, tryptophan hydroxylase; QPRT, quinolinic acid phosphoribosyl transferase.

FIG. 29

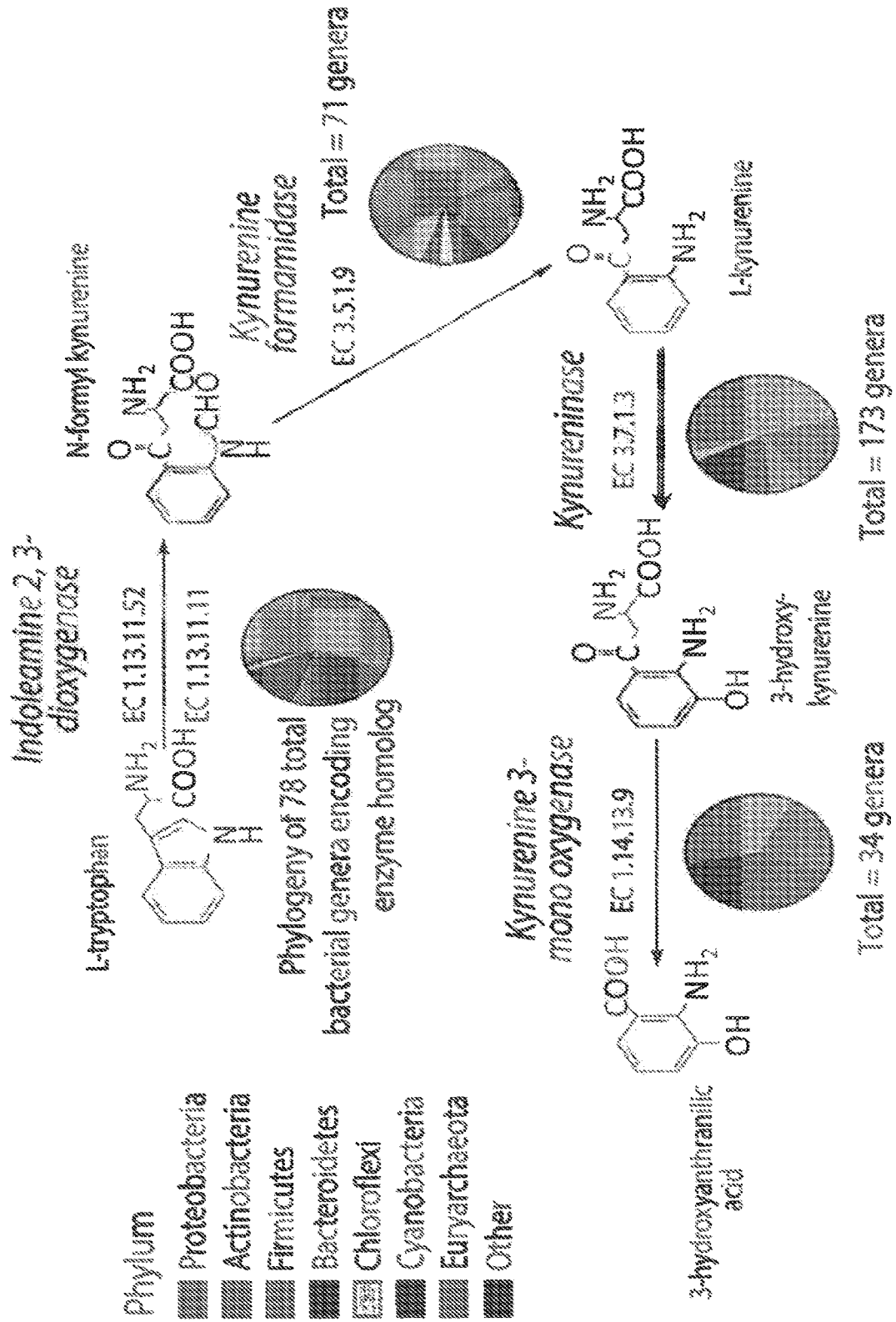

Kynurenine Synthesis

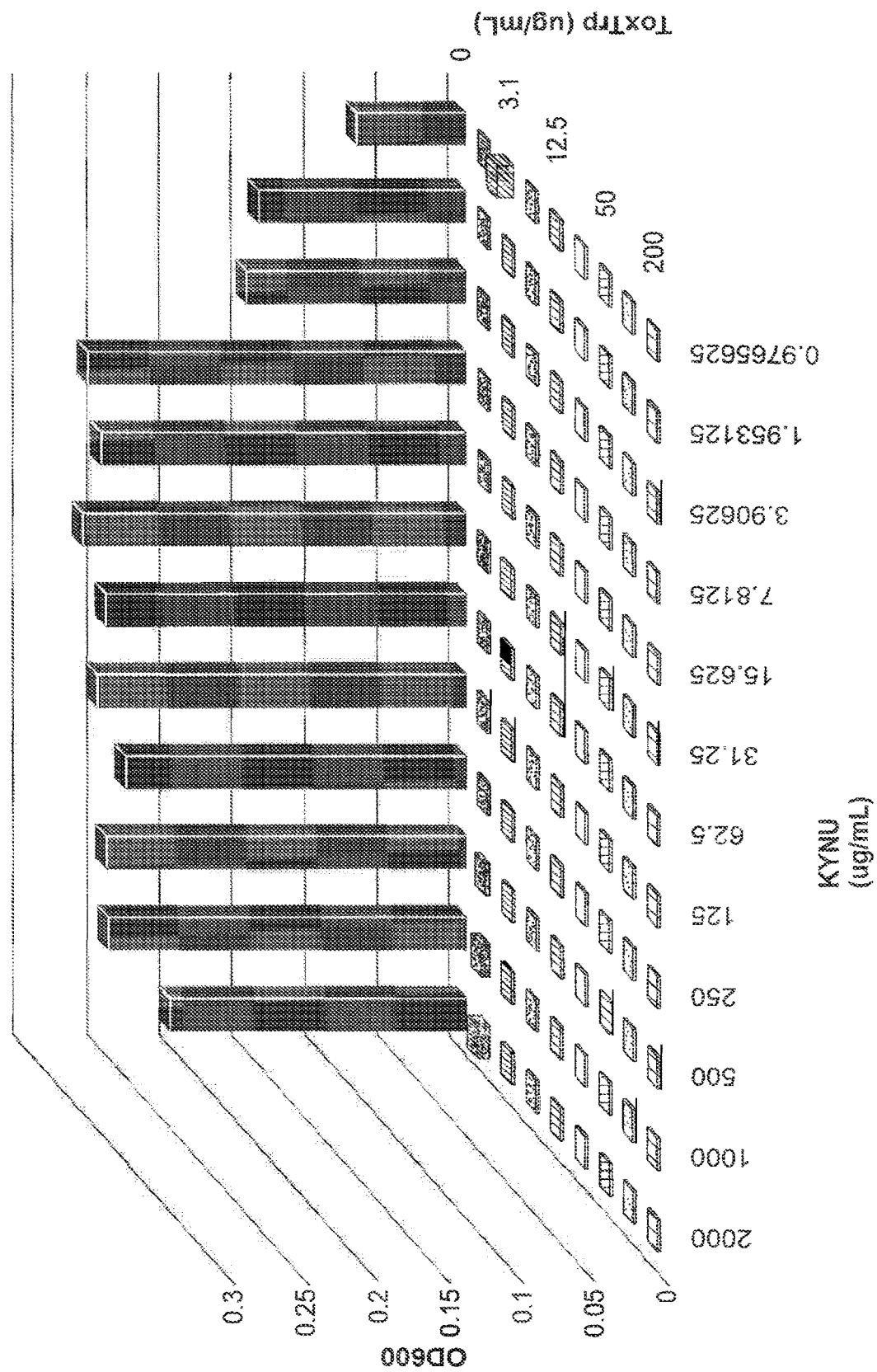

Brightness of constitutive RFP integrated in three locations:
1. AraB/C
2. MalE/K
3. MetY/ArgG
4. Nissle (non-fluorescent)

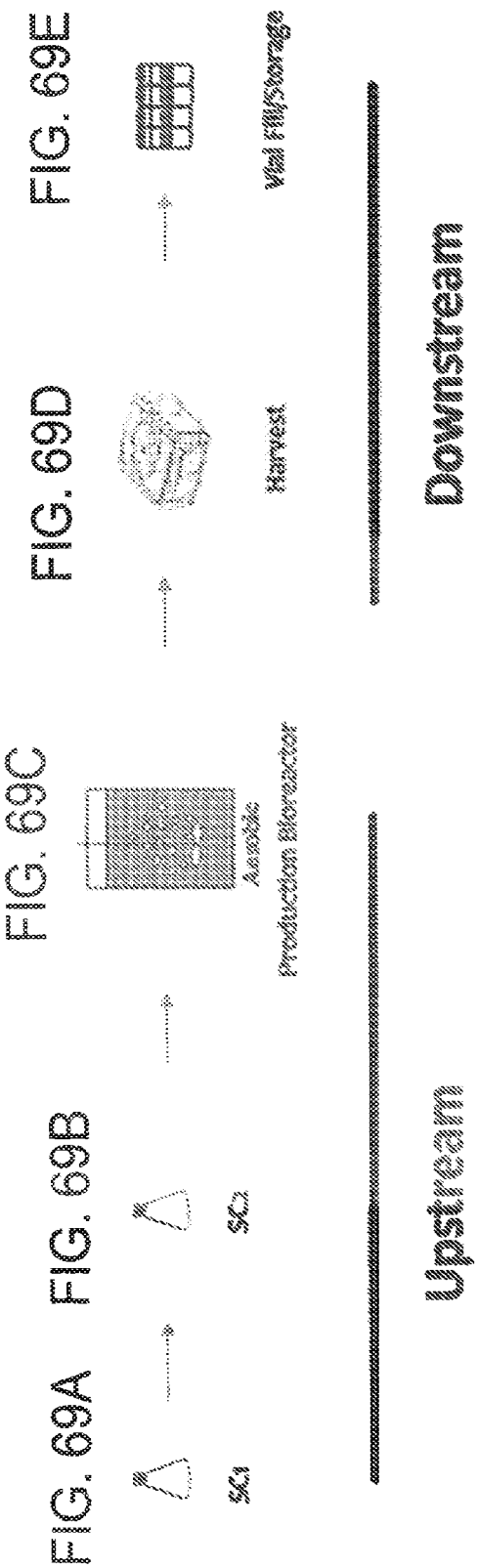

BACTERIA ENGINEERED TO TREAT METABOLIC DISEASES

The present application is a 35 U.S.C. § 371 national stage filing of International Application No. PCT/US2016/039444, filed Jun. 24, 2016, which in turn claims the benefit of priority to U.S. Provisional Patent Application No. 62/184,777, filed Jun. 25, 2015, U.S. Provisional Patent Application No. 62/347,576, filed Jun. 8, 2016, U.S. Provisional Patent Application No. 62/348,620, filed Jun. 10, 2016, U.S. Provisional Patent Application No. 62/277,346, filed Jan. 11, 2016, U.S. Provisional Patent Application No. 62/336,012, filed May 13, 2016, U.S. Provisional Patent Application No. 62/293,695, filed Feb. 10, 2016, U.S. Provisional Patent Application No. 62/347,554, filed Jun. 8, 2016, U.S. Provisional Patent Application No. 62/348,416, filed Jun. 10, 2016, U.S. Provisional Patent Application No. 62/354,681, filed Jun. 24, 2016, U.S. Provisional Patent Application No. 62/347,508, filed Jun. 8, 2016, U.S. Provisional Patent Application No. 62/354,682, filed Jun. 24, 2016, and which is a continuation-in-part of PCT International Application No. PCT/US2016/032565, filed May 13, 2016. The contents of which each of the foregoing applications are hereby incorporated by reference herein in their entirety.

The instant application contains a Sequence Listing which has been submitted electronically in ASCII format and is hereby incorporated by reference in its entirety. Said ASCII copy, created on Dec. 19, 2017, is named 126046-01805 Sequence Listing ST25.txt and is 692,653 bytes in size.

Compositions and therapeutic methods for treating metabolic diseases are provided. In certain aspects, the compositions of the invention comprise bacteria that are genetically engineered to treat, modulate, and/or ameliorate metabolic diseases, particularly in low-oxygen environments, such as in the mammalian gut. In certain aspects, the compositions and methods of the invention as disclosed herein may be used for treating metabolic diseases such as obesity and type 2 diabetes. Obesity is caused by an imbalance between energy intake and expenditure, leading to the accumulation of unused energy in the form of fat. The World Health Organization considers obesity to be a global epidemic, and the United States Centers for Disease Control and Prevention estimates that nearly one third of adult Americans are obese. Diet and exercise may help reduce obesity and its associated pathologies, but adherence to a strict diet and exercise regime is challenging. Obesity may also be caused by other factors, e.g., mutations in genes regulating metabolic pathways (e.g., satiety, fatty acid oxidation, and mitochondrial function), which can contribute to energy imbalance. For example, congenital deficits in the signaling pathways for leptin, a satiety hormone, are known to cause obesity in humans and animal models.

Patients suffering from obesity are at increased risk of developing adverse physiological conditions, e.g., non-alcoholic fatty liver, cardiovascular diseases, type 2 diabetes mellitus (T2DM). The incidence of T2DM has increased 300% in the last three decades in the United States. T2DM patients are resistant to the effects of insulin, a hormone that regulates blood glucose levels, and frequently experience hyperglycemia, a condition in which blood glucose is above physiologically tolerable levels. When left untreated, hyperglycemia can result in severe complications such as hypertension, cardiovascular disease, inflammatory disease, blood vessel damage, nerve damage, cancer, and diabetes-induced coma.

T2DM involves the dysregulation of multiple metabolic organs, such as the pancreas, liver, skeletal muscle, adipose tissue, and brain, and it has been challenging to design therapeutics that target multiple tissue while avoiding systemic side effects. Insulin has been the first-line treatment for T2DM for decades. However, patients with severe T2DM may not respond to the insulin as a result of chronic insulin resistance. In addition, insulin must be administered multiple times throughout the day, which can adversely affect quality of life. Multiple therapies have been developed to treat T2DM, but not without limitations and sometimes life-threatening side effects. For example, thiazolidinedione was once widely used in order to increase the glucose metabolism in patients. However, the compound has been pulled from certain markets due to an increased association with heart failure (Nissen et al., 2007). Likewise, inhibitors of dipeptidyl peptidase-4 (DPP-4) have shown therapeutic promise, but may be linked to increased risk of pancreatic diseases (Karagiannis, et al., 2014).

Recently, researchers have demonstrated the close relationship between gut bacteria and metabolic disease (Harley et al., 2012). In obese mice, the ratio of firmicutes to bacteroidetes bacteria is increased (Harley et al., 2012; Mathur et al., 2015). These bacteria extract different amounts of energy from food, which may contribute to changes in energy balance. Similar changes have been also been observed in human studies (Harley et al., 2012; Mathur et al., 2015). Several molecules that are produced by gut bacteria have been shown to be metabolic regulators. For example, gut bacteria digest and break down dietary fiber into molecules such as acetate, butyrate, and propionate. These molecules are absorbed through intestinal cells, transferred to organs such as the liver and brain, and produce physiological changes, such as de novo glucose production and lipid synthesis (Brissow et al., 2014; De Vadder et al., 2014; Lin et al., 2012). There has been an effort to engineer bacteria that produce N-acylphosphatidylethanolamines (NAPEs) (Chen et al., 2014). However, these bacteria express NAPEs constitutively and systemically, and NAPEs may be capable of "displac[ing] cholesterol from raft-like structures [and] may have dramatic implications for neural cell membrane function during stress and injury" (Terova et al., 2005). Thus, there is significant unmet need for effective, reliable, and/or long-term treatment for metabolic diseases, including obesity and T2DM.

In some embodiments, the invention provides genetically engineered bacteria that are capable of producing a metabolic and/or satiety effector molecule, and/or a modulator of inflammation, and/or a molecule which reduces excess bile salt levels, particularly in low-oxygen environments, e.g., the gut. In certain embodiments, the genetically engineered bacteria are non-pathogenic and may be introduced into the gut in order to treat metabolic diseases. In certain embodiments, the metabolic and/or satiety effector molecule and/or modulator of inflammation or/and or effector of excess bile salt reduction is stably produced by the genetically engineered bacteria, and/or the genetically engineered bacteria are stably maintained in vivo and/or in vitro. The invention also provides pharmaceutical compositions comprising the genetically engineered bacteria, and methods of modulating and treating metabolic diseases.

SUMMARY

The disclosure provides genetically engineered bacteria that are capable of treating metabolic diseases, including but not limited to, type 2 diabetes, obesity-related symptoms, Nonalcoholic Steatohepatitis (NASH), Prader Willi Syndrome, and cardiovascular disorders. The genetically engineered bacteria comprise one or more gene(s) or gene cassette(s), for the production of molecules which, inter alia, act as metabolic and/or satiety effectors and/or modulators of the inflammatory status and/or are able convert excess bile salts into non-toxic molecules, as described herein.

Another aspect of the invention provides methods for selecting or targeting genetically engineered bacteria based on increased levels of metabolite consumption, or production of certain metabolites. The invention also provides pharmaceutical compositions comprising the genetically engineered bacteria, and methods of modulating and treating disorders associated with metabolic disorders.

In some embodiments, the genetically engineered bacteria comprise one or more gene(s) or gene cassette(s) or circuit(s), containing one or more native or non-native component(s), which mediate one or more mechanisms of action. The genetically engineered bacteria harbor these genes or gene cassettes or circuits on a plasmid or, alternatively, the genes/gene cassettes have been inserted into the chromosome at certain regions, where they do not interfere with essential gene expression. Additionally, one or more endogenous genes or regulatory regions within the bacterial chromosome may be mutated or deleted.

These gene(s)/gene cassette(s) may be under the control of constitutive or inducible promoters. Exemplary inducible promoters described herein include oxygen level-dependent promoters (e.g., FNR-inducible promoter), promoters induced by molecules or metabolites indicative of liver damage (e.g., bilirubin) and/or metabolic disease, promoters induced by inflammation or an inflammatory response (RNS, ROS promoters), and promoters induced by a metabolite that may or may not be naturally present (e.g., can be exogenously added) in the gut, e.g., arabinose and tetracycline.

In some embodiments, the genetically engineered bacteria comprise one or more of (1) one or more gene(s) or gene cassette(s) for the production of propionate, as described herein (2) one or more gene(s) or gene cassette(s) for the production of butyrate, as described herein (3) one or more gene(s) or gene cassette(s) for the production of acetate, as described herein (4) one or more gene(s) or gene cassette(s) for the production of one or more of GLP-1 and GLP-1 analogs, as described herein (4) one or more gene(s) or gene cassette(s) for the production of one or more bile salt hydrolases, as described herein (5) one or more gene(s) or gene cassette(s) for the production of one or more transporters, e.g. for the import of bile salts and/or metabolites, e.g. tryptophan and/or tryptophan metabolites, as described herein (6) one or more polypetides for secretion, including but not limited to. GLP-1 and its analogs, bile salt hydrolases, and tryptophan synthesis and/or catabolic enzymes of the tryptophan degradation pathways, in wild type or in mutated form (for increased stability or metabolic activity) (3) one or more components of secretion machinery, as described herein (4) one or more auxotrophies, e.g., deltaThyA (5) one more antibiotic resistances, including but not limited to, kanamycin or chloramphenicol resistance (6) one or more mutations/deletions to increase the flux through a metabolic pathway encoded by one or more genes or gene cassette(s), e.g mutations/deletions in genes in NADH consuming pathways, genes involved in feedback inhibition of a metabolic pathway encoded by the gene(s) or gene cassette(s) genes, as described herein (7) one or more mutations/deletions in one or more genes of the endogenous metabolic pathways, e.g., tryptophan synthesis pathway.

BRIEF DESCRIPTION OF THE FIGURES

FIG. 3 depicts the gene organization of exemplary engineered bacteria of the disclosure and their induction under anaerobic or inflammatory conditions for the production of butyrate.

FIG. 3A depicts relatively low butyrate production under aerobic conditions in which oxygen (02) prevents (indicated by "X") FNR (grey boxed "FNR") from dimerizing and activating the FNR-responsive promoter ("FNR promoter"). Therefore, none of the butyrate biosynthesis enzymes (bcd2, etfB3, etfA3, thiA1, hbd, crt2, pbt, and buk; black boxes) is expressed. FIG. 3B depicts increased butyrate production under low-oxygen conditions due to FNR dimerizing (two grey boxed "FNR"s), binding to the FNR-responsive promoter, and inducing expression of the butyrate biosynthesis enzymes, which leads to the production of butyrate. FIGS. 3C and 3D depict the gene organization of an exemplary recombinant bacterium of the invention and its derepression in the presence of nitric oxide (NO). In FIG. 3C, in the absence of NO, the NsrR transcription factor (gray circle, "NsrR") binds to and represses a corresponding regulatory region. Therefore, none of the butyrate biosynthesis enzymes (bcd2, etfB3, etfA3, thiA1, hbd, crt2, pbt, buk; black boxes) is expressed. In FIG. 3D, in the presence of NO, the NsrR transcription factor interacts with NO, and no longer binds to or represses the regulatory sequence. This leads to expression of the butyrate biosynthesis enzymes (indicated by gray arrows and black squiggles) and ultimately to the production of butyrate. In FIG. 3E, in the absence of H2O2, the OxyR transcription factor (gray circle, "OxyR") binds to, but does not induce, the oxyS promoter. Therefore, none of the butyrate biosynthesis enzymes (bcd2, etfB3, etfA3, thiA1, hbd, crt2, pbt, buk; black boxes) is expressed.

FIG. 4 depicts the gene organization of exemplary recombinant bacteria of the disclosure and their induction under anaerobic or inflammatory conditions for the production of butyrate. FIG. 4A depicts relatively low butyrate production under aerobic conditions in which oxygen ($O_2$) prevents (indicated by "X") FNR (grey boxed "FNR") from dimerizing and activating the FNR-responsive promoter ("FNR promoter"). Therefore, none of the butyrate biosynthesis enzymes (ter, thiA1, hbd, crt2, pbt, and buk; black boxes) is expressed. FIG. 4B depicts increased butyrate production under low-oxygen conditions due to FNR dimerizing (two grey boxed "FNR"s), binding to the FNR-responsive promoter, and inducing expression of the butyrate biosynthesis enzymes, which leads to the production of butyrate. In FIG. 4C, in the absence of NO, the NsrR transcription factor (gray circle, "NsrR") binds to and represses a corresponding regulatory region. Therefore, none of the butyrate biosynthesis enzymes (ter, thiA1, hbd, crt2, pbt, buk; black boxes) is expressed. In FIG. 4D, in the presence of NO, the NsrR transcription factor interacts with NO, and no longer binds to or represses the regulatory sequence. This leads to expression of the butyrate biosynthesis enzymes (indicated by gray arrows and black squiggles) and ultimately to the production of butyrate. In FIG. 4E, in the absence of $H_2O_2$, the OxyR transcription factor (gray circle, "OxyR") binds to, but does not induce, the oxyS promoter. Therefore, none of the butyrate biosynthesis enzymes (ter, thiA1, hbd, crt2, pbt, buk; black boxes) is expressed. In FIG. 4F, in the presence of $H_2O_2$, the OxyR transcription factor interacts with $H_2O_2$ and is then capable of inducing the oxyS promoter. This leads to expression of the butyrate biosynthesis enzymes (indicated by gray arrows and black squiggles) and ultimately to the production of butyrate.

FIG. 5 depicts the gene organization of exemplary recombinant bacteria of the disclosure and their induction under anaerobic or inflammatory conditions for the production of butyrate. FIG. 5A depicts relatively low butyrate production under aerobic conditions in which oxygen ($O_2$) prevents (indicated by "X") FNR (grey boxed "FNR") from dimerizing and activating the FNR-responsive promoter ("FNR promoter"). Therefore, none of the butyrate biosynthesis enzymes (ter, thiA1, hbd, crt2, and tesB; black boxes) is expressed. FIG. 5B depicts increased butyrate production under low-oxygen conditions due to FNR dimerizing (two grey boxed "FNR"s), binding to the FNR-responsive promoter, and inducing expression of the butyrate biosynthesis enzymes, which leads to the production of butyrate. In FIG. 5C, in the absence of NO, the NsrR transcription factor (gray circle, "NsrR") binds to and represses a corresponding regulatory region. Therefore, none of the butyrate biosynthesis enzymes (ter, thiA1, hbd, crt2, tesB; black boxes) is expressed. In FIG. 5D, in the presence of NO, the NsrR transcription factor interacts with NO, and no longer binds to or represses the regulatory sequence. This leads to expression of the butyrate biosynthesis enzymes (indicated by gray arrows and black squiggles) and ultimately to the production of butyrate. In FIG. 5E, in the absence of $H_2O_2$, the OxyR transcription factor (gray circle, "OxyR") binds to, but does not induce, the oxyS promoter. Therefore, none of the butyrate biosynthesis enzymes (ter, thiA1, hbd, crt2, tesB; black boxes) is expressed. In FIG. 5F, in the presence of $H_2O_2$, the OxyR transcription factor interacts with $H_2O_2$ and is then capable of inducing the oxyS promoter. This leads to expression of the butyrate biosynthesis enzymes (indicated by gray arrows and black squiggles) and ultimately to the production of butyrate.

FIG. 6 depicts a graph of butyrate production using the circuits shown in FIG. 48. Cells were grown in M9 minimal media containing 0.2% glucose and induced with ATC at early log phase. As seen in FIG. 6A, similar amounts of butyrate were produced for each construct under aerobic vs anaerobic conditions. The ter strain produces more butyrate overall. pLogic031 comprises (bdc2 butyrate cassette under control of tet promoter on a plasmid) and pLogic046 comprises (ter butyrate cassette under control of tet promoter on a plasmid).

FIG. 9 depicts butyrate production by genetically engineered Nissle comprising the pLogic031-nsrR-norB-butyrate construct (SYN-507) or the pLogic046-nsrR-norB-butyrate construct (SYN-508), which produce more butyrate as compared to wild-type Nissle.

FIG. 10 depicts a scatter graph of butyrate concentrations in the feces of mice gavaged with either H2O, 100 mM butyrate in H20, streptomycin resistant Nissle control or SYN501 comprising a PydfZ-ter→pbt-buk butyrate plasmid. Significantly greater levels of butyrate were detected in the feces of the mice gavaged with SYN501 as compared mice gavaged with the Nissle control or those given water only. Levels are close to 2 mM and higher than the levels seen in the mice fed with H20 (+) 200 mM butyrate.

FIG. 13 depicts the gene organization of an exemplary engineered bacterium of the invention and its induction under low-oxygen conditions for the production of propionate.

FIG. 15A depicts relatively low propionate production under aerobic conditions in which oxygen ($O_2$) prevents (indicated by "X") FNR (grey boxed "FNR") from dimerizing and activating the FNR-responsive promoter ("FNR promoter"). Therefore, none of the propionate biosynthesis enzymes (thrA, thrB, thrC, ilvA, aceE, aceF, lpd; black boxes) are expressed. FIG. 15B depicts increased propionate production under low-oxygen conditions due to FNR dimerizing (two grey boxed "FNR"s), binding to the FNR-responsive promoter, and inducing expression of the propionate biosynthesis enzymes, which leads to the production of propionate. FIG. 15C depicts an exemplary propionate biosynthesis gene cassette.

FIGS. 16A, 16B and 16C depict the gene organization of an exemplary engineered bacterium and its induction under low-oxygen conditions for the production of propionate. FIG. 16A depicts relatively low propionate production under aerobic conditions in which oxygen ($O_2$) prevents (indicated by "X") FNR (grey boxed "FNR") from dimerizing and activating the FNR-responsive promoter ("FNR promoter"). Therefore, none of the propionate biosynthesis enzymes (thrA, thrB, thrC, ilvA, aceE, aceF, lpd, tesB; black boxes) are expressed. FIG. 16B depicts increased propionate production under low-oxygen conditions due to FNR dimerizing (two grey boxed "FNR"s), binding to the FNR-responsive promoter, and inducing expression of the propionate biosynthesis enzymes, which leads to the production of propionate.

FIG. 20 depicts a propionate production strategy.

FIG. 29 depicts a schematic of tryptophan metabolism in humans. The abbreviations for the enzymes are as follows: 3-HAO: 3-hydroxyl-anthranilate 3,4-dioxidase; AAAD: aromatic—amino acid decarboxylase; ACMSD, alpha-amino-beta-carboxymuconate-epsilon-semialdehyde decarboxylase; HIOMT, hydroxyl-O-methyltransferase; IDO, indoleamine 2,3-dioxygenase; KAT, kynurenine amino transferases I-III; KMO: kynurenine 3-monooxygenase; KYNU, kynureninase; NAT, N-acetyltransferase; TDO, tryptophan 2,3-dioxygenase; TPH, tryptophan hydroxylase; QPRT, quinolinic acid phosphoribosyl transferase. In certain embodiments of the disclosure, the genetically engineered bacteria comprise gene cassettes comprising one or more of the tryptophan metabolism enzymes depicted in FIG. 26, or bacterial functional homologs thereof. In certain embodiments of the disclosure, the genetically engineered bacteria comprise gene cassettes which produce one or more of the tryptophan metabolites depicted in FIG. 29. In certain embodiments, the one or more cassettes are on a plasmid; in other embodiments, the cassettes are integrated into the genome. In certain embodiments the one or more cassettes are under the control of inducible promoters which are induced under low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose.

FIG. 30 depicts a schematic of Bacterial tryptophan catabolism machinery, which is genetically and functionally homologous to IDO1 enzymatic activity, as described in Vujkovic-Cvijin et al., Dysbiosis of the gut microbiota is associated with HIV disease progression and tryptophan catabolism; Sci Transl Med. 2013 Jul. 10; 5(193): 193ra91, the contents of which is herein incorporated by reference in its entirety. In certain embodiments of the disclosure, the genetically engineered bacteria comprise gene cassettes comprising one or more of the bacterial tryptophan metabolism enzymes depicted in FIG. 30. In certain embodiments, the genetically engineered bacteria comprise one or more gene cassettes which produce one or more of the metabolites depicted in FIG. 30, including but not limited to, kynurenine, indole-3-aldehyde, indole-3-acetic acid, and/or indole-3 acetaldehyde. In certain embodiments, the one or more cassettes are on a plasmid; in other embodiments, the cassettes are integrated into the genome. In certain embodiments the one or more cassettes are under the control of inducible promoters which are induced under low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose.

FIG. 36 depicts a bar graphs showing the results of a checkerboard assay to establish the concentrations of kynurenine and 5-fluoro-L-tryptophan (ToxTrp) capable of sustaining growth of a trpE mutant of *E. coli* Nissle expressing pseudoKYNase. In FIG. 36A, Bacteria were grown in the presence of different concentrations of KYNU and ToxTrp, and in the absence of Anhydrous Tetracycline (aTc). Growth was assessed at OD600.

FIG. 37 depicts schematics of non-limiting examples of embodiments of the disclosure. In all embodiments, optionally gene(s) which encode exporters may also be included.

In FIG. 38D the circuits for tryptophan production are as depicted and described in FIG. 27. Alternatively, tryptophan can be imported through a transporter. In addition, the genetically engineered bacteria comprise a circuit comprising cyp79B2 (tryptophan N-monooxygenase, e.g., from *Arabidopsis thaliana*) or cyp79B3 (tryptophan N-monooxygenase, e.g., from *Arabidopsis thaliana* and cyp71a13 (indoleacetaldoxime dehydratase, e.g., from *Arabidopis thaliana*) and nit1 (Nitrilase, e.g., from *Arabidopsis thaliana*) and iaaH (Indoleacetamide hydrolase, e.g., from *Pseudomonas savastanoi*), under the control of an inducible promoter e.g., an FNR promoter.

FIG. 56A also depicts another non-limiting embodiment of the disclosure, wherein the expression of an essential gene not found in the recombinant bacteria is activated by an exogenous environmental signal. In the absence of arabinose, the AraC transcription factor adopts a conformation that represses transcription of the essential gene under the control of the araBAD promoter and the bacterial cell cannot survive. In the presence of arabinose, the AraC transcription factor undergoes a conformational change that allows it to bind to and activate the araBAD promoter, which induces expression of the essential gene and maintains viability of the bacterial cell.

FIG. 66 depicts a bar graph of residence over time for streptomycin resistant Nissle.

FIGS. 69A, B, C, D, and E depict a schematic of non-limiting manufacturing processes for upstream and downstream production of the genetically engineered bacteria of the present disclosure. FIG. 69A depicts the parameters for starter culture 1 (SC1): loop full—glycerol stock, duration overnight, temperature 37° C., shaking at 250 rpm. FIG. 69B depicts the parameters for starter culture 2 (SC2): 1/100 dilution from SC1, duration 1.5 hours, temperature 37° C., shaking at 250 rpm.

FIG. 69C depicts the parameters for the production bioreactor: inoculum—SC2, temperature 37° C., pH set point 7.00, pH dead band 0.05, dissolved oxygen set point 50%, dissolved oxygen cascade agitation/gas FLO, agitation limits 300-1200 rpm, gas FLO limits 0.5-20 standard liters per minute, duration 24 hours. FIG. 69D depicts the parameters for harvest: centrifugation at speed 4000 rpm and duration 30 minutes, wash 1×10% glycerol/PBS, centrifugation, re-suspension 10% glycerol/PBS. FIG. 69E depicts the parameters for vial fill/storage: 1-2 mL aliquots, −80° C.

DESCRIPTION OF EMBODIMENTS

Figure 1:
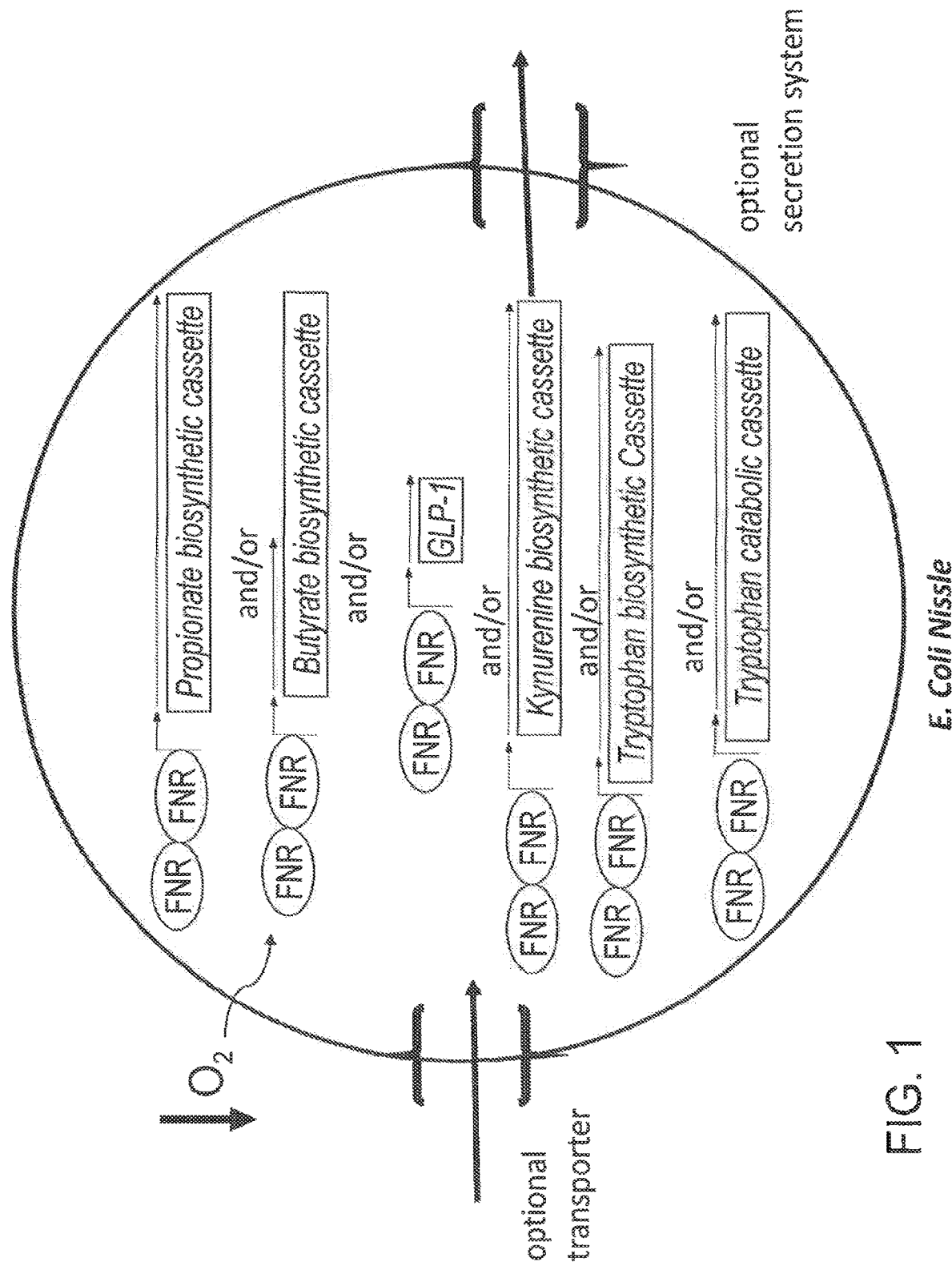
FIG. 1 depicts a schematic of an *E. coli* that is genetically engineered to express a kynurenine biosynthesis cassette and/or a tryptophan biosynthesis cassette and/or tryptophan catabolic cassette which produces bioactive tryptophan metabolites described herein and/or GLP-1 and/or a propionate gene cassette and/or a butyrate gene cassette under the control of a FNR-responsive promoter and further comprising a secretion system and a metabolite transporter system.
Figure 2A:
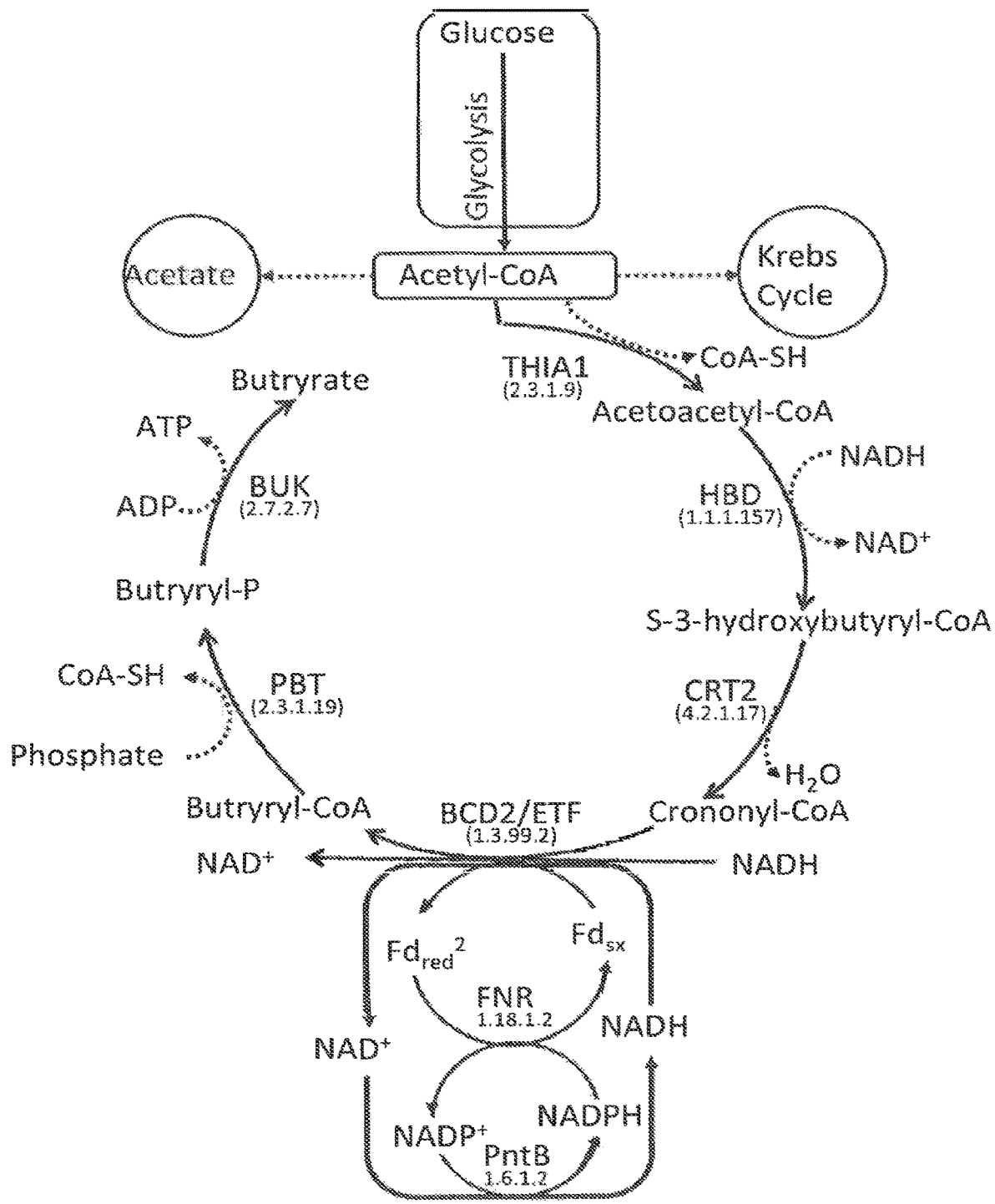
FIG. 2A depicts a metabolic pathway for butyrate production
Figure 2B:
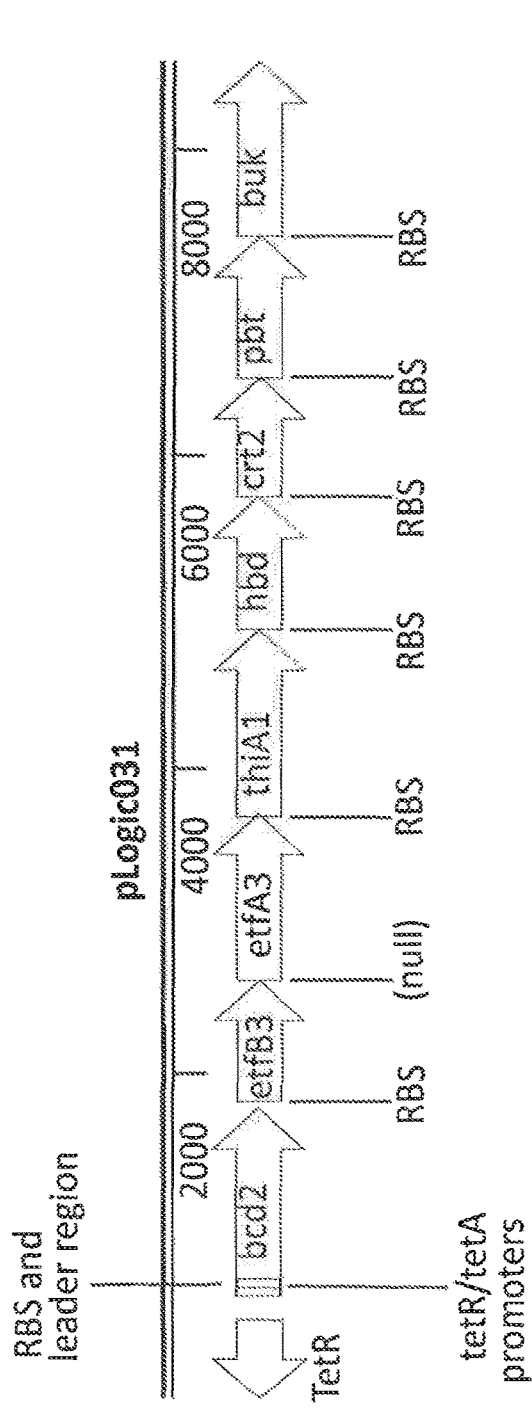
FIGS. 2B and 2C depict two schematics of two different butyrate producing circuits (found in SYN-UCD503 and SYN-UCD504), both under the control of a tetracycline inducible promoter.
Figure 2C:
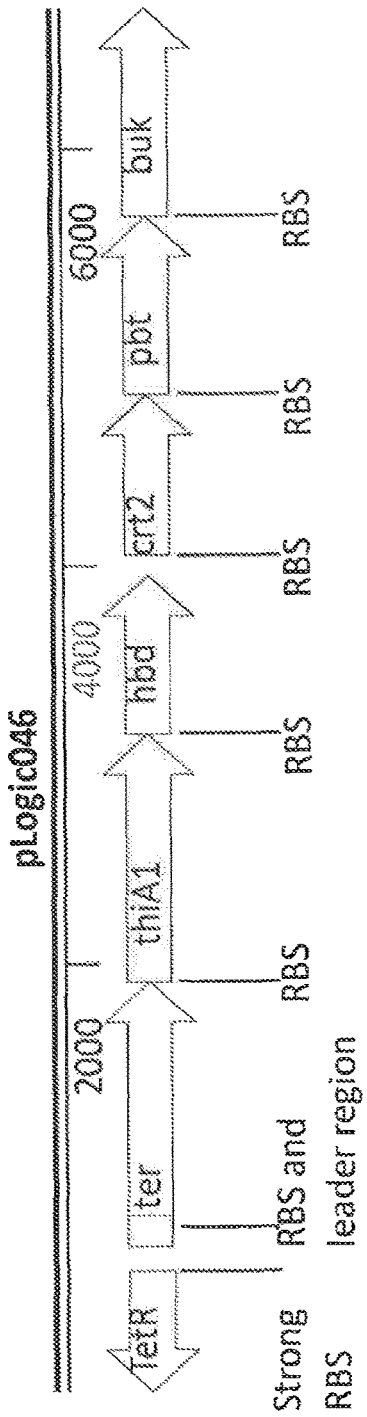
Figure 2D:
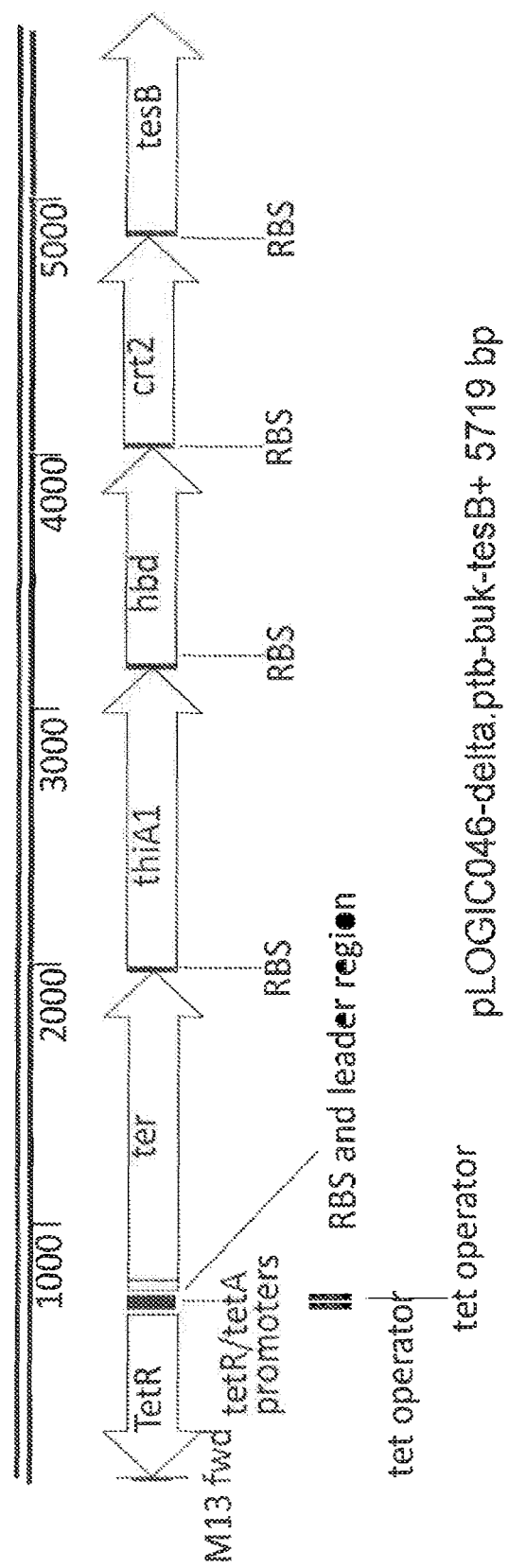
FIG. 2D depicts a schematic of a third butyrate gene cassette (found in SYN-UCD505) under the control of a tetracycline inducible promoter. SYN-UCD503 comprises a bdc2 butyrate cassette under control of tet promoter on a plasmid. A "bdc2 cassette" or "bdc2 butyrate cassette" refres to a butyrate producing cassette that comprises at least the following genes: bcd2, etfB3, etfA3, hbd, crt2, pbt, and buk genes. SYN-UCD504 comprises a ter butyrate cassette (ter gene replaces the bcd2, etfB3, and etfA3 genes) under control of tet promoter on a plasmid. A "ter cassette" or "ter butyrate cassette" refers to a butyrate producing cassete that comprises at least the following genes: ter, thiA1, hbd, crt2, pbt, buk. SYN-UCD505 comprises a tesB butyrate cassette (ter gene is present and tesB gene replaces the pbt gene and the buk gene) under control of tet promoter on a plasmid. A "tes or tesB cassette or "tes or tesB butyrate cassette" refers to a butyrate producing cassette that comprises at least ter, thiA1, hbd, crt2, and tesB genes. An alternative butyrate cassette of the disclosure comprises at least bcd2, etfB3, etfA3, thiA1, hbd, crt2, and tesB genes. In some embodiments, the tes or tesB cassette is under control of an inducible promoter other than tetracycline. Exemplary inducible promoters which may control the expression of the tesB cassette include oxygen level-dependent promoters (e.g., FNR-inducible promoter), promoters induced by HE-specific molecules or metabolites indicative of liver damage (e.g., bilirubin), promoters induced by inflammation or an inflammatory response (RNS, ROS promoters), and promoters induced by a metabolite that may or may not be naturally present (e.g., can be exogenously added) in the gut, e.g., arabinose and tetracycline.
Figure 3A:
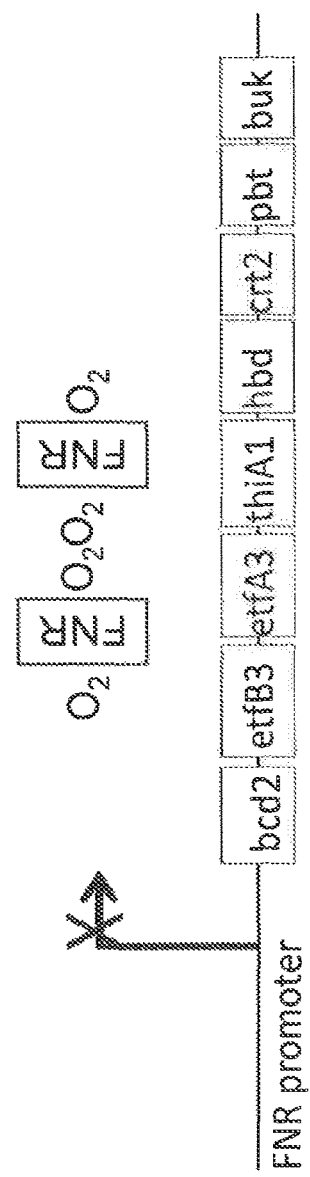
FIGS. 3A and 3B depict the gene organization of an exemplary recombinant bacterium of the invention and its induction under low-oxygen conditions.
Figure 3B:
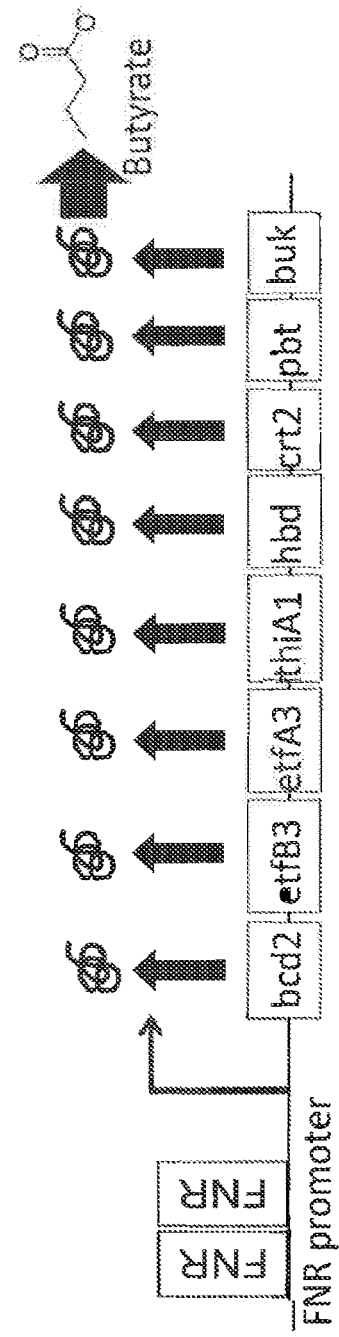
Figure 3E:
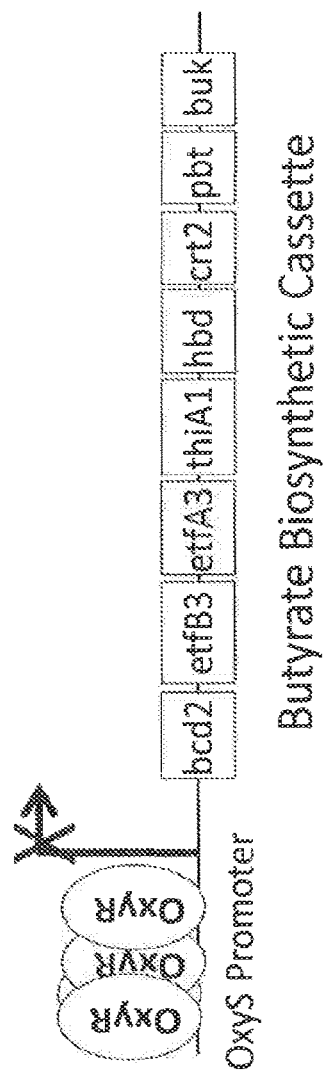
FIGS. 3E and F depict the gene organization of an exemplary recombinant bacterium of the invention and its induction in the presence of H2O2.
Figure 3F:
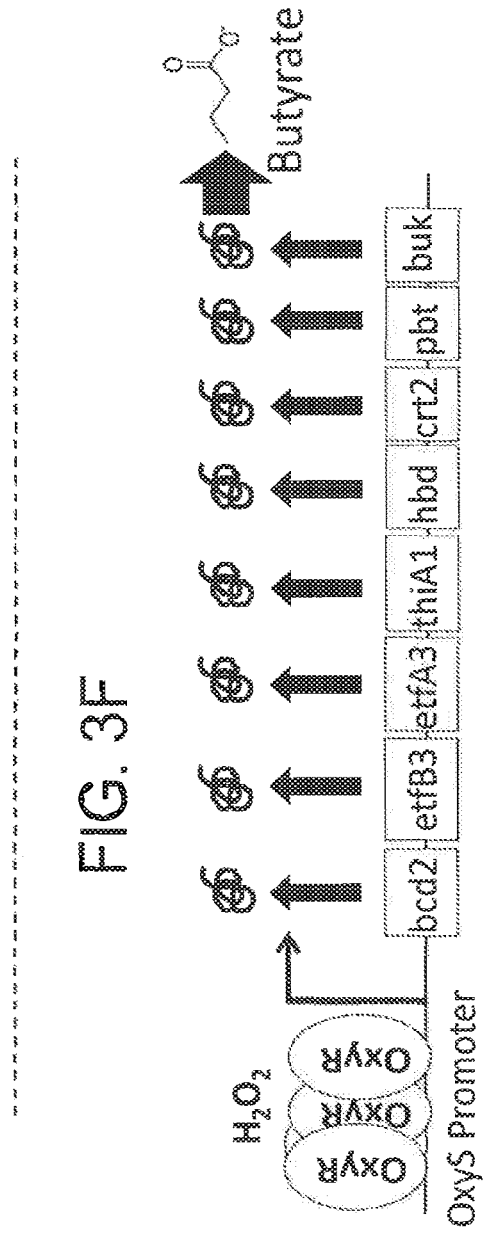
In FIG. 3F, in the presence of H2O2, the OxyR transcription factor interacts with H2O2 and is then capable of inducing the oxyS promoter. This leads to expression of the butyrate biosynthesis enzymes (indicated by gray arrows and black squiggles) and ultimately to the production of butyrate.
Figure 4A:
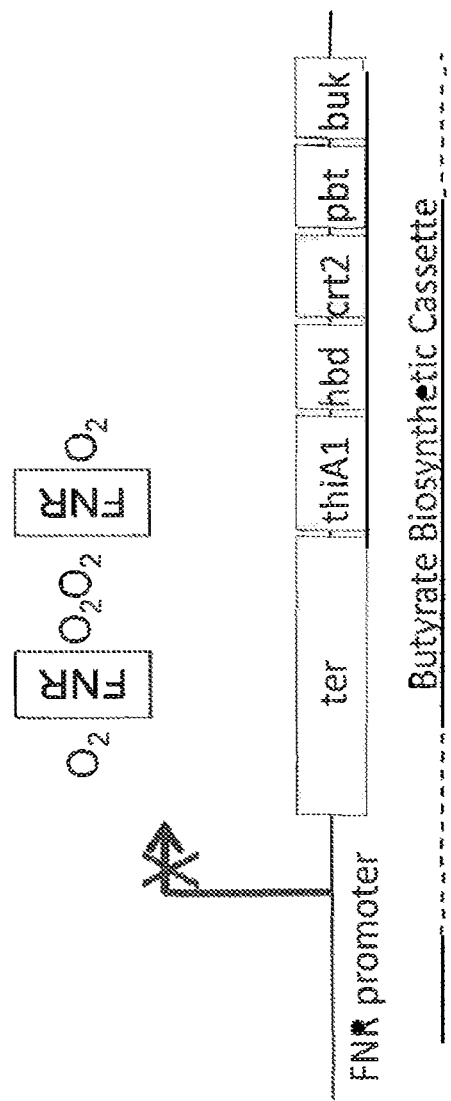
FIGS. 4A and 4B depict the gene organization of an exemplary recombinant bacterium of the invention and its induction under low-oxygen conditions.
Figure 4B:
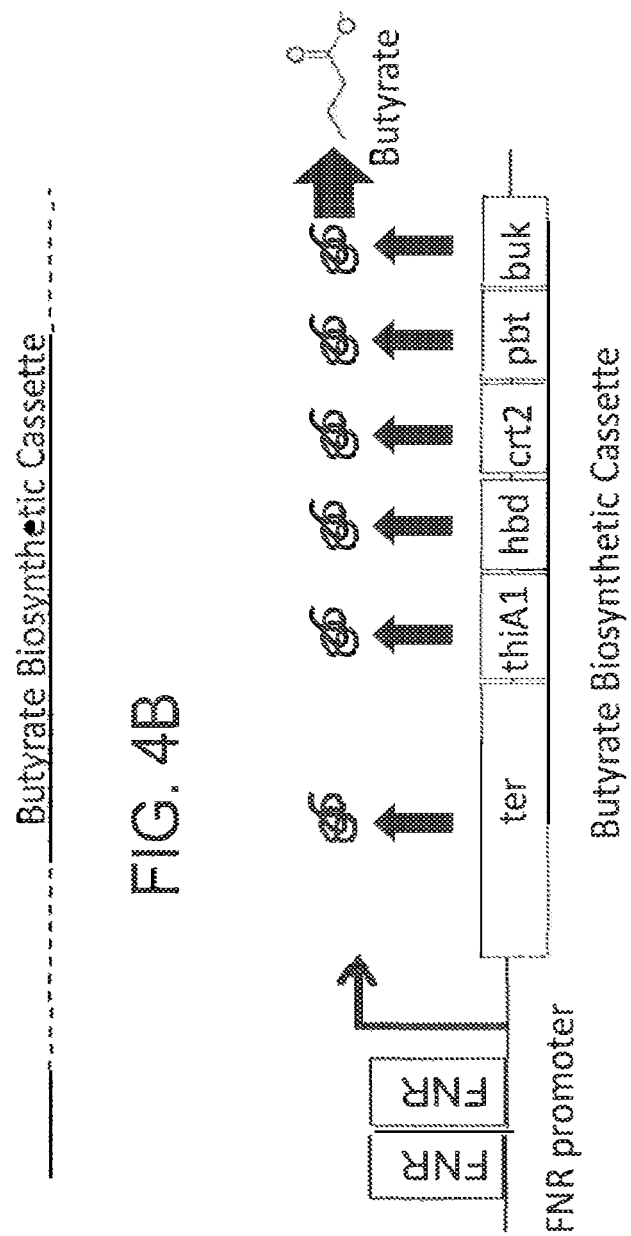
Figure 4C:
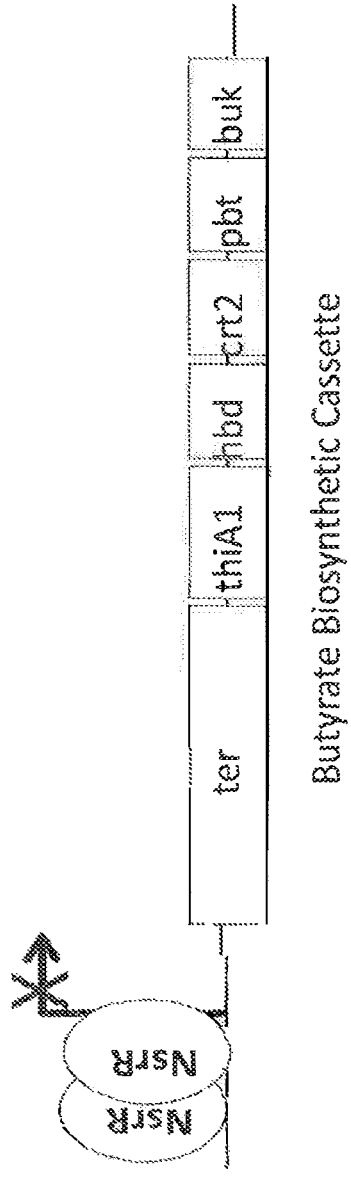
FIGS. 4C and 4D depict the gene organization of another exemplary recombinant bacterium of the invention and its derepression in the presence of NO.
Figure 4D:
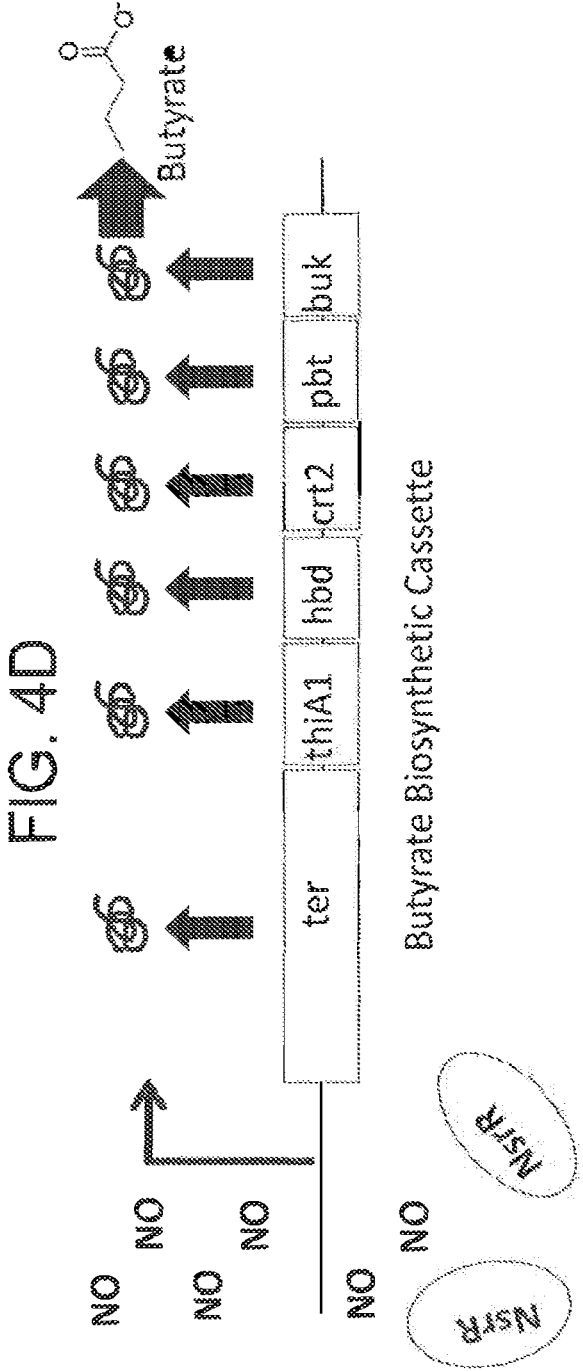
Figure 4E:
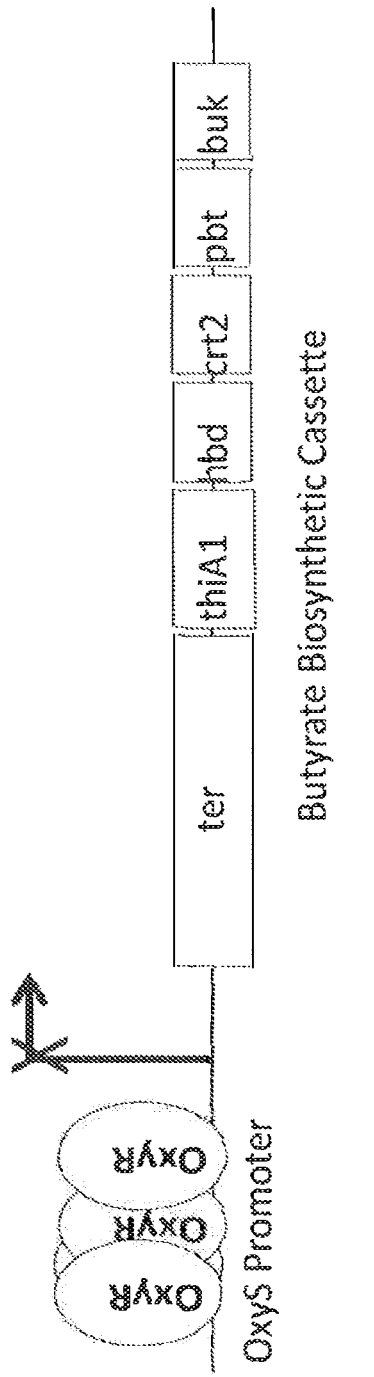
FIGS. 4E and 4F depict the gene organization of another exemplary recombinant bacterium of the invention and its induction in the presence of $H_2O_2$.
Figure 4F:
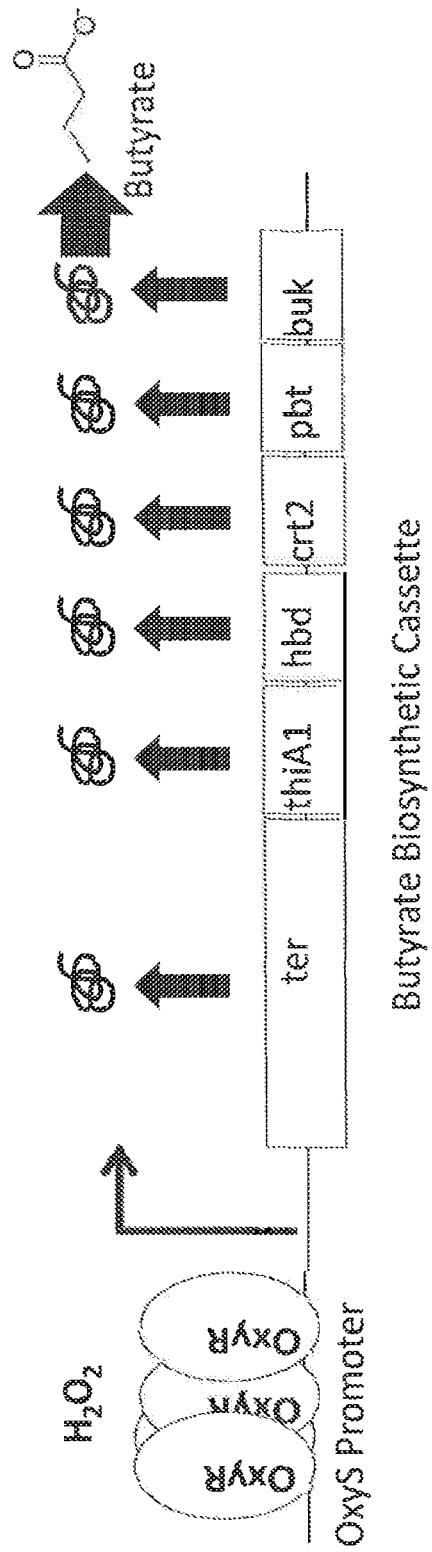
Figure 5A:
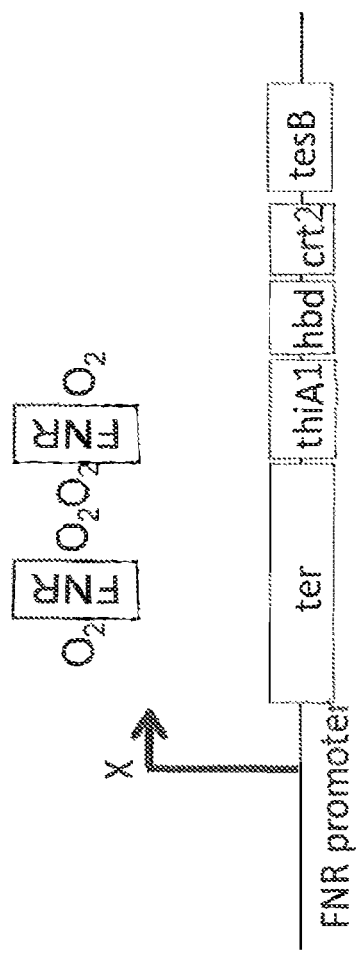
FIGS. 5A and 5B depict the gene organization of an exemplary recombinant bacterium of the invention and its induction under low-oxygen conditions.
Figure 5B:
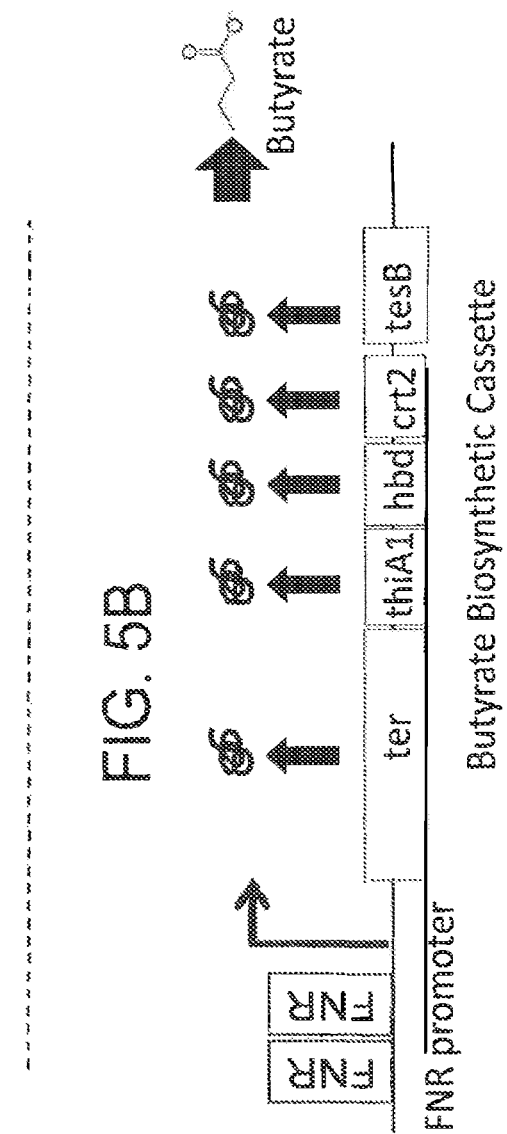
Figure 5C:
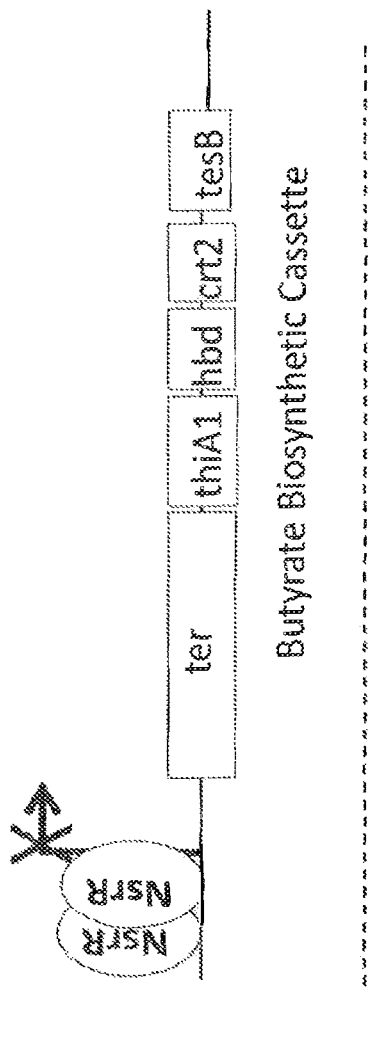
FIGS. 5C and 5D depict the gene organization of another exemplary recombinant bacterium of the invention and its derepression in the presence of NO.
Figure 5D:
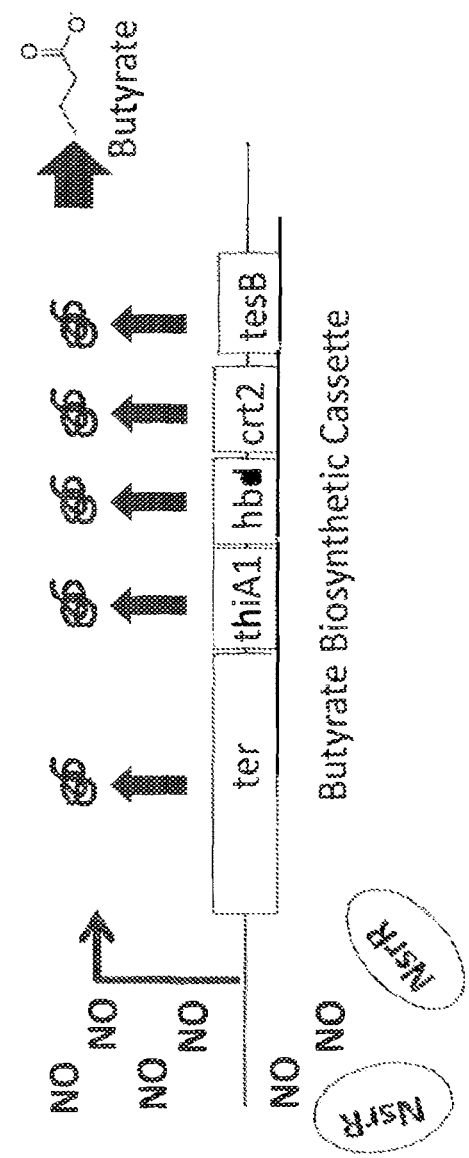
Figure 5E:
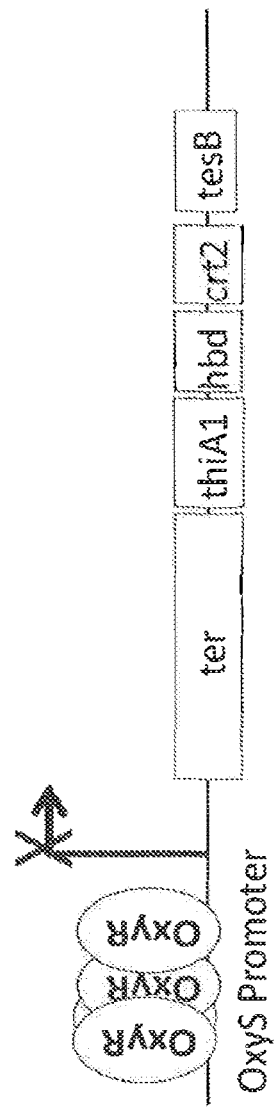
FIGS. 5E and 5F depict the gene organization of another exemplary recombinant bacterium of the invention and its induction in the presence of $H_2O_2$.
Figure 5F:
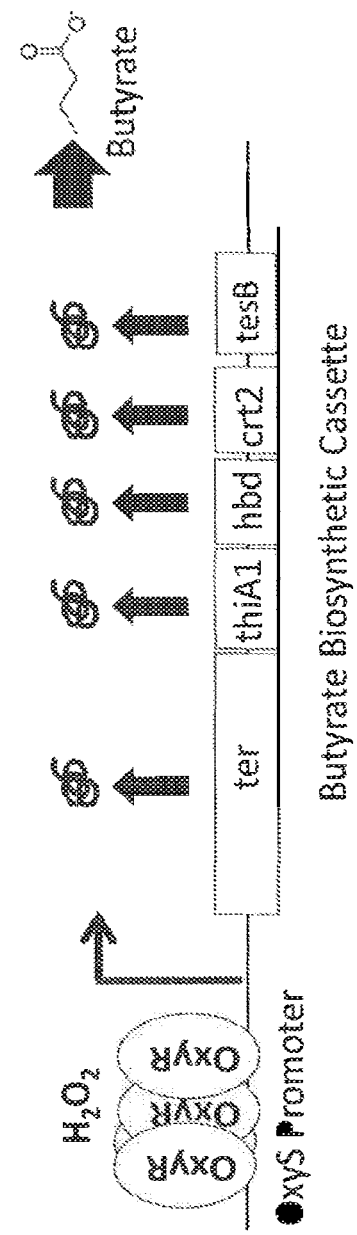

The invention includes genetically engineered bacteria, pharmaceutical compositions thereof, and methods of modulating and treating metabolic diseases. In some embodiments, the genetically engineered bacteria of the invention comprise a gene encoding a non-native metabolic and/or satiety effector molecule, or a gene cassette encoding a non-native biosynthetic pathway for producing a non-native metabolic and/or satiety effector molecule. The gene or gene cassette is further operably linked to a regulatory region that is controlled by a transcription factor that is capable of sensing low-oxygen conditions. The genetically engineered bacteria are capable of producing metabolic and/or satiety effector molecule in low-oxygen environments, e.g., the gut. Thus, the genetically engineered bacteria and pharmaceutical compositions comprising those bacteria may be used in order to treat and/or prevent conditions associated with metabolic diseases, including obesity and type 2 diabetes.

In order that the disclosure may be more readily understood, certain terms are first defined. These definitions should be read in light of the remainder of the disclosure and as understood by a person of ordinary skill in the art. Unless defined otherwise, all technical and scientific terms used herein have the same meaning as commonly understood by a person of ordinary skill in the art. Additional definitions are set forth throughout the detailed description.

As used herein, "metabolic diseases" include, but are not limited to, type 1 diabetes; type 2 diabetes; metabolic syndrome; Bardet-Biedel syndrome; Prader-Willi syndrome; non-alcoholic fatty liver disease; tuberous sclerosis; Albright hereditary osteodystrophy; brain-derived neurotrophic factor (BDNF) deficiency; Single-minded 1 (SIM1) deficiency; leptin deficiency; leptin receptor deficiency; pro-opiomelanocortin (POMC) defects; proprotein convertase subtilisin/kexin type 1 (PCSK1) deficiency; Src homology 2B1 (SH2B1) deficiency; pro-hormone convertase 1/3 deficiency; melanocortin-4-receptor (MC4R) deficiency; Wilms tumor, aniridia, genitourinary anomalies, and mental retardation (WAGR) syndrome; pseudohypoparathyroidism type 1A; Fragile X syndrome; Borjeson-Forsmann-Lehmann syndrome; Alstrom syndrome; Cohen syndrome; and ulnar-mammary syndrome.

Symptoms associated with the aforementioned diseases and conditions include, but are not limited to, one or more of weight gain, obesity, fatigue, hyperlipidemia, hyperphagia, hyperdipsia, polyphagia, polydipsia, polyuria, pain of the extremities, numbness of the extremities, blurry vision, nystagmus, hearing loss, cardiomyopathy, insulin resistance, light sensitivity, pulmonary disease, liver disease, liver cirrhosis, liver failure, kidney disease, kidney failure, seizures, hypogonadism, and infertility.

Metabolic diseases are associated with a variety of physiological changes, including but not limited to elevated glucose levels, elevated triglyceride levels, elevated cholesterol levels, insulin resistance, high blood pressure, hypogonadism, subfertility, infertility, abdominal obesity, prothrombotic conditions, and pro-inflammatory conditions. A metabolic effector is a molecule that is capable of minimizing any one or more of said physiological changes. For example, a metabolic effector molecule may enhance the body's sensitivity to insulin, thereby ameliorating insulin resistance. Insulin resistance is a physiological condition in which the body's insulin becomes less effective at lowering blood sugar. Excess blood sugar can cause adverse health effects such as type 2 diabetes. "Satiety" is used to refer to a homeostatic state in which a subject feels that hunger or food craving is minimized or satisfied. A satiety effector is a molecule that contributes to the minimization or satisfaction of said hunger or food craving. A molecule may be primarily a metabolic effector or primarily a satiety effector. A molecule may be both a metabolic and satiety effector, e.g., GLP-1.

"Metabolic effector molecules" and/or "satiety effector molecules" include, but are not limited to, n-acyl-phophatidylethanolamines (NAPEs), n-acyl-ethanolamines (NAEs), ghrelin receptor antagonists, peptide YY3-36, cholecystokinin (CCK) family molecules, CCK58, CCK33, CCK22, CCK8, bombesin family molecules, bombesin, gastrin releasing peptide (GRP), neuromedin B (P), glucagon, GLP-1, GLP-2, apolipoprotein A-IV, amylin, somatostatin, enterostatin, oxyntomodulin, pancreatic peptide, short-chain fatty acids, butyrate, propionate, acetate, serotonin receptor agonists, nicotinamide adenine dinucleotide (NAD), nicotinamide mononucleotide (NMN), nucleotide riboside (NR), nicotinamide, and nicotinic acid (NA). Such molecules may also include compounds that inhibit a molecule that promotes metabolic disease, e.g., a single-chain variable fragment (scFv), antisense RNA, siRNA, or shRNA that inhibits dipeptidyl peptidase-4 (DPP4) or ghrelin receptor. A metabolic and/or satiety effector molecule may be encoded by a single gene, e.g., glucogon-like peptide 1 is encoded by the GLP-1 gene. Alternatively, a metabolic and/or satiety effector molecule may be synthesized by a biosynthetic pathway requiring multiple genes, e.g., propionate. These molecules may also be referred to as therapeutic molecules.

As used herein, the term "engineered bacterial cell" or "engineered bacteria" refers to a bacterial cell or bacteria that have been genetically modified from their native state. For instance, an engineered bacterial cell may have nucleotide insertions, nucleotide deletions, nucleotide rearrangements, and nucleotide modifications introduced into their DNA. These genetic modifications may be present in the chromosome of the bacteria or bacterial cell, or on a plasmid in the bacteria or bacterial cell. Engineered bacterial cells disclosed herein may comprise exogenous nucleotide sequences on plasmids. Alternatively, engineered bacterial cells may comprise exogenous nucleotide sequences stably incorporated into their chromosome.

A "programmed bacterial cell" or "programmed engineered bacterial cell" is an engineered bacterial cell that has been genetically modified from its native state to perform a specific function. In certain embodiments, the programmed or engineered bacterial cell has been modified to express one or more proteins, for example, one or more proteins that have a therapeutic activity or serve a therapeutic purpose. The programmed or engineered bacterial cell may additionally have the ability to stop growing or to destroy itself once the protein(s) of interest have been expressed.

As used herein, a "heterologous" gene or "heterologous sequence" refers to a nucleotide sequence that is not normally found in a given cell in nature. As used herein, a heterologous sequence encompasses a nucleic acid sequence that is exogenously introduced into a given cell. "Heterologous gene" includes a native gene, or fragment thereof, that has been introduced into the host cell in a form that is different from the corresponding native gene. For example, a heterologous gene may include a native coding sequence that is a portion of a chimeric gene to include a native coding sequence that is a portion of a chimeric gene to include non-native regulatory regions that is reintroduced into the host cell. A heterologous gene may also include a native gene, or fragment thereof, introduced into a non-native host cell. Thus, a heterologous gene may be foreign or native to the recipient cell; a nucleic acid sequence that is naturally found in a given cell but expresses an unnatural amount of the nucleic acid and/or the polypeptide which it encodes; and/or two or more nucleic acid sequences that are not found in the same relationship to each other in nature. As used herein, the term "endogenous gene" refers to a native gene in its natural location in the genome of an organism. As used herein, the term "transgene" refers to a gene that has been introduced into the host organism, e.g., host bacterial cell, genome.

As used herein, the term "coding region" refers to a nucleotide sequence that codes for a specific amino acid sequence. The term "regulatory sequence" refers to a nucleotide sequence located upstream (5' non-coding sequences), within, or downstream (3' non-coding sequences) of a coding sequence, and which influences the transcription, RNA processing, RNA stability, or translation of the associated coding sequence. Examples of regulatory sequences include, but are not limited to, promoters, translation leader sequences, effector binding sites, and stem-loop structures. In one embodiment, the regulatory sequence comprises a promoter, e.g., an FNR responsive promoter.

As used herein, a "gene cassette" or "operon" encoding a biosynthetic pathway refers to the two or more genes that are required to produce a metabolic and/or satiety effector molecule, e.g., propionate. In addition to encoding a set of genes capable of producing said molecule, the gene cassette or operon may also comprise additional transcription and translation elements, e.g., a ribosome binding site.

A "butyrogenic gene cassette," "butyrate biosynthesis gene cassette," and "butyrate operon" are used interchangeably to refer to a set of genes capable of producing butyrate in a biosynthetic pathway. Unmodified bacteria that are capable of producing butyrate via an endogenous butyrate biosynthesis pathway include, but are not limited to, *Clostridium, Peptoclostridium, Fusobacterium, Butyrivibrio, Eubacterium,* and *Treponema*. The genetically engineered bacteria of the invention may comprise butyrate biosynthesis genes from a different species, strain, or substrain of bacteria, or a combination of butyrate biosynthesis genes from different species, strains, and/or substrains of bacteria. A butyrogenic gene cassette may comprise, for example, the eight genes of the butyrate production pathway from *Peptoclostridium difficile* (also called *Clostridium difficile*): bcd2, etfB3, etfA3, thiA1, hbd, crt2, pbt, and buk, which encode butyryl-CoA dehydrogenase subunit, electron transfer flavoprotein subunit beta, electron transfer flavoprotein subunit alpha, acetyl-CoA C-acetyltransferase, 3-hydroxybutyryl-CoA dehydrogenase, crotonase, phosphate butyryltransferase, and butyrate kinase, respectively (Aboulnaga et al., 2013). One or more of the butyrate biosynthesis genes may be functionally replaced or modified, e.g., codon optimized. *Peptoclostridium difficile* strain 630 and strain 1296 are both capable of producing butyrate, but comprise different nucleic acid sequences for etfA3, thiA1, hbd, crt2, pbt, and buk. A butyrogenic gene cassette may comprise bcd2, etfB3, etfA3, and thiA1 from *Peptoclostridium difficile* strain 630, and hbd, crt2, pbt, and buk from *Peptoclostridium difficile* strain 1296. Alternatively, a single gene from *Treponema denticola* (ter, encoding trans-2-enoynl-CoA reductase) is capable of functionally replacing all three of the bcd2, etfB3, and etfA3 genes from *Peptoclostridium difficile*. Thus, a butyrogenic gene cassette may comprise thiA1, hbd, crt2, pbt, and buk from *Peptoclostridium difficile* and ter from *Treponema denticola*. The butyrogenic gene cassette may comprise genes for the aerobic biosynthesis of butyrate and/or genes for the anaerobic or microaerobic biosynthesis of butyrate. In another example of a butyrate gene cassette, the pbt and buk genes are replaced with tesB (e.g., from *E. coli*). Thus a butyrogenic gene cassette may comprise ter, thiA1, hbd, crt2, and tesB.

Likewise, a "propionate gene cassette" or "propionate operon" refers to a set of genes capable of producing propionate in a biosynthetic pathway. Unmodified bacteria that are capable of producing propionate via an endogenous propionate biosynthesis pathway include, but are not limited to, *Clostridium propionicum, Megasphaera elsdenii,* and *Prevotella ruminicola*. The genetically engineered bacteria of the invention may comprise propionate biosynthesis genes from a different species, strain, or substrain of bacteria, or a combination of propionate biosynthesis genes from different species, strains, and/or substrains of bacteria. In some embodiments, the propionate gene cassette comprises acrylate pathway propionate biosynthesis genes, e.g., pet, lcdA, lcdB, lcdC, etfA, acrB, and acrC, which encode propionate CoA-transferase, lactoyl-CoA dehydratase A, lactoyl-CoA dehydratase B, lactoyl-CoA dehydratase C, electron transfer flavoprotein subunit A, acryloyl-CoA reductase B, and acryloyl-CoA reductase C, respectively (Hetzel et al., 2003, Selmer et al., 2002, and Kandasamy 2012 Engineering *Escherichia coli* with acrylate pathway genes for propionic acid synthesis and its impact on mixed-acid fermentation). This operon catalyses the reduction of lactate to propionate. Dehydration of (R)-lactoyl-CoA leads to the production of the intermediate acryloyl-CoA by lactoyl-CoA dehydratase (LcdABC). Acrolyl-CoA is converted to propionyl-CoA by acrolyl-CoA reductase (EtfA, AcrBC). In some embodiments, the rate limiting step catalyzed by the enzymes encoded by etfA, acrB and acrC, are replaced by the acul gene from *R. sphaeroides*. This gene product catalyzes the NADPH-dependent acrylyl-CoA reduction to produce propionyl-CoA (Acrylyl-Coenzyme A Reductase, an Enzyme Involved in the Assimilation of 3-Hydroxypropionate by *Rhodobacter sphaeroides*; Asao 2013). Thus the propionate cassette comprises pet, lcdA, lcdB, lcdC, and acul. In another embodiment, the homolog of Acul in *E. coli*, YhdH is used (see. e.g., Structure of *Escherichia coli* YhdH, a putative quinone oxidoreductase. Sulzenbacher 2004). This the propionate cassette comprises pet, lcdA, lcdB, lcdC, and yhdH. In alternate embodiments, the propionate gene cassette comprises pyruvate pathway propionate biosynthesis genes (see, e.g., Tseng et al., 2012), e.g., thrAfbr, thrB, thrC, ilvAfbr, aceE, aceF, and lpd, which encode homoserine dehydrogenase 1, homoserine kinase, L-threonine synthase, L-threonine dehydratase, pyruvate dehydrogenase, dihydrolipoamide acetyltrasferase, and dihydrolipoyl dehydrogenase, respectively. In some embodiments, the propionate gene cassette further comprises tesB, which encodes acyl-CoA thioesterase.

In another example of a propionate gene cassette comprises the genes of the Sleeping Beauty Mutase operon, e.g., from *E. coli* (sbm, ygfD, ygfG, ygfH). Recently, this pathway has been considered and utilized for the high yield industrial production of propionate from glycerol (Akawi et al., Engineering *Escherichia coli* for high-level production of propionate; J Ind Microbiol Biotechnol (2015) 42:1057-1072, the contents of which is herein incorporated by reference in its entirety). In addition, as described herein, it has been found that this pathway is also suitable for production of proprionate from glucose, e.g. by the genetically engineered bacteria of the disclosure. The SBM pathway is cyclical and composed of a series of biochemical conversions forming propionate as a fermentative product while regenerating the starting molecule of succinyl-CoA. Sbm (methylmalonyl-CoA mutase) converts succinyl CoA to L-methylmalonylCoA, YgfD is a Sbm-interacting protein kinase with GTPase activity, ygfG (methylmalonylCoA decarboxylase) converts L-methylmalonylCoA into PropionylCoA, and ygfH (propionyl-CoA/succinylCoA transferase) converts propionylCoA into propionate and succinate into succinylCoA (Sleeping beauty mutase (sbm) is expressed and interacts with ygfd in *Escherichia coli*; Froese 2009). This pathway is very similar to the oxidative propionate pathway of Propionibacteria, which also converts succinate to propionate. Succinyl-CoA is converted to R-methylmalonyl-CoA by methymalonyl-CoA mutase (mutAB). This is in turn converted to S-methylmalonyl-CoA via methymalonyl-CoA epimerase (GI: 18042134). There are three genes which encode methylmalonyl-CoA carboxytransferase (mmdA, PFREUD_18870, bccp) which converts methylmalonyl-CoA to propionyl-CoA.

The propionate gene cassette may comprise genes for the aerobic biosynthesis of propionate and/or genes for the anaerobic or microaerobic biosynthesis of propionate. One or more of the propionate biosynthesis genes may be functionally replaced or modified, e.g., codon optimized.

An "acetate gene cassette" or "acetate operon" refers to a set of genes capable of producing acetate in a biosynthetic pathway. Bacteria "synthesize acetate from a number of carbon and energy sources," including a variety of substrates such as cellulose, lignin, and inorganic gases, and utilize different biosynthetic mechanisms and genes, which are known in the art (Ragsdale et al., 2008). The genetically engineered bacteria of the invention may comprise acetate biosynthesis genes from a different species, strain, or sub-strain of bacteria, or a combination of acetate biosynthesis genes from different species, strains, and/or substrains of bacteria. *Escherichia coli* are capable of consuming glucose and oxygen to produce acetate and carbon dioxide during aerobic growth (Kleman et al., 1994). Several bacteria, such as *Acetitomaculum, Acetoanaerobium, Acetohalobium, Acetonema, Balutia, Butyribacterium, Clostridium, Moorella, Oxobacter, Sporomusa*, and *Thermoacetogenium*, are acetogenic anaerobes that are capable of converting CO or $CO_2+H_2$ into acetate, e.g., using the Wood-Ljungdahl pathway (Schiel-Bengelsdorf et al, 2012). Genes in the Wood-Ljungdahl pathway for various bacterial species are known in the art. The acetate gene cassette may comprise genes for the aerobic biosynthesis of acetate and/or genes for the anaerobic or microaerobic biosynthesis of acetate. One or more of the acetate biosynthesis genes may be functionally replaced or modified, e.g., codon optimized.

Each gene or gene cassette may be present on a plasmid or bacterial chromosome. In addition, multiple copies of any gene, gene cassette, or regulatory region may be present in the bacterium, wherein one or more copies of the gene, gene cassette, or regulatory region may be mutated or otherwise altered as described herein. In some embodiments, the genetically engineered bacteria are engineered to comprise multiple copies of the same gene, gene cassette, or regulatory region in order to enhance copy number or to comprise multiple different components of a gene cassette performing multiple different functions.

Each gene or gene cassette may be operably linked to a promoter that is induced under low-oxygen conditions. "Operably linked" refers a nucleic acid sequence, e.g., a gene or gene cassette for producing a metabolic and/or satiety effector molecule, that is joined to a regulatory region sequence in a manner which allows expression of the nucleic acid sequence, e.g., acts in cis. A regulatory region is a nucleic acid that can direct transcription of a gene of interest and may comprise promoter sequences, enhancer sequences, response elements, protein recognition sites, inducible elements, promoter control elements, protein binding sequences, 5' and 3' untranslated regions, transcriptional start sites, termination sequences, polyadenylation sequences, and introns.

A "directly inducible promoter" refers to a regulatory region, wherein the regulatory region is operably linked to a gene or a gene cassette encoding a biosynthetic pathway for producing a metabolic and/or satiety effector molecule, e.g. propionate. In the presence of an inducer of said regulatory region, a metabolic and/or satiety effector molecule is expressed. An "indirectly inducible promoter" refers to a regulatory system comprising two or more regulatory regions, for example, a first regulatory region that is operably linked to a gene encoding a first molecule, e.g., a transcription factor, which is capable of regulating a second regulatory region that is operably linked to a gene or a gene cassette encoding a biosynthetic pathway for producing a metabolic and/or satiety effector molecule, e.g. propionate. In the presence of an inducer of the first regulatory region, the second regulatory region may be activated or repressed, thereby activating or repressing production of propionate. Both a directly inducible promoter and an indirectly inducible promoter are encompassed by "inducible promoter."

"Exogenous environmental condition(s)" refers to setting(s) or circumstance(s) under which the promoter described above is directly or indirectly induced. In some embodiments, the exogenous environmental conditions are specific to the gut of a mammal. In some embodiments, the exogenous environmental conditions are specific to the upper gastrointestinal tract of a mammal. In some embodiments, the exogenous environmental conditions are specific to the lower gastrointestinal tract of a mammal. In some embodiments, the exogenous environmental conditions are specific to the small intestine of a mammal. In some embodiments, the exogenous environmental conditions are low-oxygen or anaerobic conditions such as the environment of the mammalian gut. In some embodiments, exogenous environmental conditions are molecules or metabolites that are specific to the mammalian gut, e.g., propionate. In some embodiments, the gene or gene cassette for producing a therapeutic molecule is operably linked to an oxygen level-dependent promoter. Bacteria have evolved transcription factors that are capable of sensing oxygen levels. Different signaling pathways may be triggered by different oxygen levels and occur with different kinetics. An "oxygen level-dependent promoter" or "oxygen level-dependent regulatory region" refers to a nucleic acid sequence to which one or more oxygen level-sensing transcription factors is capable of binding, wherein the binding and/or activation of the corresponding transcription factor activates downstream gene expression.

In some embodiments, the gene or gene cassette for producing a metabolic and/or satiety effector molecule is operably linked to an oxygen level-dependent regulatory region such that the effector molecule is expressed in low-oxygen, microaerobic, or anaerobic conditions. For example, the oxygen level-dependent regulatory region is operably linked to a propionate gene cassette; in low oxygen conditions, the oxygen level-dependent regulatory region is activated by a corresponding oxygen level-sensing transcription factor, thereby driving expression of the propionate gene cassette. Examples of oxygen level-dependent transcription factors and corresponding promoters and/or regulatory regions include, but are not limited to, FNR, ANR, and DNR. Corresponding FNR-responsive promoters, ANR-responsive promoters, and DNR-responsive promoters are known in the art (see, e.g., Castiglione et al., 2009; Eiglmeier et al., 1989; Galimand et al., 1991; Hasegawa et al., 1998; Hoeren et al., 1993; Salmon et al., 2003), and non-limiting examples are shown in Table 1.

TABLE 1

Examples of transcription factors and responsive genes and regulatory regions

| Transcription Factor | Examples of responsive genes, promoters, and/or regulatory regions: |
|---|---|
| FNR | nirB, ydfZ, pdhR, focA, ndH, hlyE, narK, narX, narG, yfiD, tdcD Table 4 |
| ANR | arcDABC |
| DNR | norb, norC |

As used herein, a "non-native" nucleic acid sequence refers to a nucleic acid sequence not normally present in a bacterium, e.g., an extra copy of an endogenous sequence, or a heterologous sequence such as a sequence from a different species, strain, or substrain of bacteria, or a sequence that is modified and/or mutated as compared to the unmodified sequence from bacteria of the same subtype. In some embodiments, the non-native nucleic acid sequence is a synthetic, non-naturally occurring sequence (see, e.g., Purcell et al., 2013). The non-native nucleic acid sequence may be a regulatory region, a promoter, a gene, and/or one or more genes in gene cassette. In some embodiments, "non-native" refers to two or more nucleic acid sequences that are not found in the same relationship to each other in nature. The non-native nucleic acid sequence may be present on a plasmid or chromosome. In some embodiments, the genetically engineered bacteria of the invention comprise a gene cassette that is operably linked to a directly or indirectly inducible promoter that is not associated with said gene cassette in nature, e.g., a FNR-responsive promoter operably linked to a propionate gene cassette.

"Constitutive promoter" refers to a promoter that is capable of facilitating continuous transcription of a coding sequence or gene under its control and/or to which it is operably linked. Constitutive promoters and variants are well known in the art and include, but are not limited to, BBa_J23100, a constitutive $Escherichia$ $coli$ $\sigma^S$ promoter (e.g., an osmY promoter (International Genetically Engineered Machine (iGEM) Registry of Standard Biological Parts Name BBa_J45992; BBa_J45993)), a constitutive $Escherichia$ $coli$ $\sigma^{32}$ promoter (e.g., htpG heat shock promoter (BBa_J45504)), a constitutive $Escherichia$ $coli$ $\sigma^{70}$ promoter (e.g., lacq promoter (BBa_J54200; BBa_J56015), $E.$ $coli$ CreABCD phosphate sensing operon promoter (BBa_J64951), GlnRS promoter (BBa_K088007), lacZ promoter (BBa_K119000; BBa_K119001); M13K07 gene I promoter (BBa_M13101); M13K07 gene II promoter (BBa_M13102), M13K07 gene III promoter (BBa_M13103), M13K07 gene IV promoter (BBa_M13104), M13K07 gene V promoter (BBa_M13105), M13K07 gene VI promoter (BBa_M13106), M13K07 gene VIII promoter (BBa_M13108), M13110 (BBa_M13110)), a constitutive $Bacillus$ $subtilis$ $\sigma^A$ promoter (e.g., promoter veg (BBa_K143013), promoter 43 (BBa_K143013), $P_{liaG}$ (BBa_K823000), $P_{lepA}$ (BBa_K823002), $P_{veg}$ (BBa_K823003)), a constitutive $Bacillus$ $subtilis$ $\sigma^B$ promoter (e.g., promoter ctc (BBa_K143010), promoter gsiB (BBa_K143011)), a $Salmonella$ promoter (e.g., Pspv2 from $Salmonella$ (BBa_K112706), Pspv from $Salmonella$ (BBa_K112707)), a bacteriophage T7 promoter (e.g., T7 promoter (BBa_I712074; BBa_I719005; BBa_J34814; BBa_J64997; BBa_K113010; BBa_K113011; BBa_K113012; BBa_R0085; BBa_R0180; BBa_R0181; BBa_R0182; BBa_R0183; BBa_Z0251; BBa_Z0252; BBa_Z0253)), and a bacteriophage SP6 promoter (e.g., SP6 promoter (BBa_J64998)).

"Gut" refers to the organs, glands, tracts, and systems that are responsible for the transfer and digestion of food, absorption of nutrients, and excretion of waste. In humans, the gut comprises the gastrointestinal (GI) tract, which starts at the mouth and ends at the anus, and additionally comprises the esophagus, stomach, small intestine, and large intestine. The gut also comprises accessory organs and glands, such as the spleen, liver, gallbladder, and pancreas. The upper gastrointestinal tract comprises the esophagus, stomach, and duodenum of the small intestine. The lower gastrointestinal tract comprises the remainder of the small intestine, i.e., the jejunum and ileum, and all of the large intestine, i.e., the cecum, colon, rectum, and anal canal.

Bacteria can be found throughout the gut, e.g., in the gastrointestinal tract, and particularly in the intestines.

"Microorganism" refers to an organism or microbe of microscopic, submicroscopic, or ultramicroscopic size that typically consists of a single cell. Examples of microorganisms include bacteria, viruses, parasites, fungi, certain algae, and protozoa. In some aspects, the microorganism is engineered ("engineered microorganism") to produce one or more therapeutic molecules. In certain aspects, the microorganism is engineered to import and/or catabolize certain toxic metabolites, substrates, or other compounds from its environment, e.g., the gut. In certain aspects, the microorganism is engineered to synthesize certain beneficial metabolites, molecules, or other compounds (synthetic or naturally occurring) and release them into its environment. In certain embodiments, the engineered microorganism is an engineered bacterium. In certain embodiments, the engineered microorganism is an engineered virus.

"Non-pathogenic bacteria" refer to bacteria that are not capable of causing disease or harmful responses in a host. In some embodiments, non-pathogenic bacteria are Gram-negative bacteria. In some embodiments, non-pathogenic bacteria are Gram-positive bacteria. In some embodiments, non-pathogenic bacteria are commensal bacteria, which are present in the indigenous microbiota of the gut. Examples of non-pathogenic bacteria include, but are not limited to *Bacillus, Bacteroides, Bifidobacterium, Brevibacteria, Clostridium, Enterococcus, Escherichia, Lactobacillus, Lactococcus, Saccharomyces*, and *Staphylococcus*, e.g., *Bacillus coagulans, Bacillus subtilis, Bacteroides fragilis, Bacteroides subtilis, Bacteroides thetaiotaomicron, Bifidobacterium bifidum, Bifidobacterium infantis, Bifidobacterium lactis, Bifidobacterium longum, Clostridium butyricum, Enterococcus faecium, Escherichia coli, Lactobacillus acidophilus, Lactobacillus bulgaricus, Lactobacillus casei, Lactobacillus johnsonii, Lactobacillus paracasei, Lactobacillus plantarum, Lactobacillus reuteri, Lactobacillus rhamnosus, Lactococcus lactis*, and *Saccharomyces boulardii* (Sonnenborn et al., 2009; Dinleyici et al., 2014; U.S. Pat. Nos. 6,835,376; 6,203,797; 5,589,168; 7,731,976). Naturally pathogenic bacteria may be genetically engineered to provide reduce or eliminate pathogenicity.

"Probiotic" is used to refer to live, non-pathogenic microorganisms, e.g., bacteria, which can confer health benefits to a host organism that contains an appropriate amount of the microorganism. In some embodiments, the host organism is a mammal. In some embodiments, the host organism is a human. Some species, strains, and/or subtypes of non-pathogenic bacteria are currently recognized as probiotic. Examples of probiotic bacteria include, but are not limited to, *Bifidobacteria, Escherichia, Lactobacillus*, and *Saccharomyces*, e.g., *Bifidobacterium bifidum, Enterococcus faecium, Escherichia coli, Escherichia coli* strain Nissle, *Lactobacillus acidophilus, Lactobacillus bulgaricus, Lactobacillus paracasei, Lactobacillus plantarum*, and *Saccharomyces boulardii* (Dinleyici et al., 2014; U.S. Pat. Nos. 5,589,168; 6,203,797; 6,835,376). Non-pathogenic bacteria may be genetically engineered to enhance or improve desired biological properties, e.g., survivability. Non-pathogenic bacteria may be genetically engineered to provide probiotic properties. Probiotic bacteria may be genetically engineered to enhance or improve probiotic properties.

As used herein, the term "modulate" and its cognates means to alter, regulate, or adjust positively or negatively a molecular or physiological readout, outcome, or process, to effect a change in said readout, outcome, or process as compared to a normal, average, wild-type, or baseline measurement. Thus, for example, "modulate" or "modulation" includes up-regulation and down-regulation. A non-limiting example of modulating a readout, outcome, or process is effecting a change or alteration in the normal or baseline functioning, activity, expression, or secretion of a biomolecule (e.g. a protein, enzyme, cytokine, growth factor, hormone, metabolite, short chain fatty acid, or other compound). Another non-limiting example of modulating a readout, outcome, or process is effecting a change in the amount or level of a biomolecule of interest, e.g. in the serum and/or the gut lumen. In another non-limiting example, modulating a readout, outcome, or process relates to a phenotypic change or alteration in one or more disease symptoms. Thus, "modulate" is used to refer to an increase, decrease, masking, altering, overriding or restoring the normal functioning, activity, or levels of a readout, outcome or process (e.g, biomolecule of interest, and/or molecular or physiological process, and/or a phenotypic change in one or more disease symptoms).

As used herein, "stably maintained" or "stable" bacterium is used to refer to a bacterial host cell carrying non-native genetic material, e.g., a propionate gene cassette, which is incorporated into the host genome or propagated on a self-replicating extra-chromosomal plasmid, such that the non-native genetic material is retained, expressed, and/or propagated. The stable bacterium is capable of survival and/or growth in vitro, e.g., in medium, and/or in vivo, e.g., in the gut. For example, the stable bacterium may be a genetically modified bacterium comprising a propionate gene cassette, in which the plasmid or chromosome carrying the propionate gene cassette is stably maintained in the host cell, such that the gene cassette can be expressed in the host cell, and the host cell is capable of survival and/or growth in vitro and/or in vivo.

As used herein, the term "treat" and its cognates refer to an amelioration of a disease or disorder, or at least one discernible symptom thereof. In another embodiment, "treat" refers to an amelioration of at least one measurable physical parameter, not necessarily discernible by the patient. In another embodiment, "treat" refers to inhibiting the progression of a disease or disorder, either physically (e.g., stabilization of a discernible symptom), physiologically (e.g., stabilization of a physical parameter), or both. In another embodiment, "treat" refers to slowing the progression or reversing the progression of a disease or disorder. As used herein, "prevent" and its cognates refer to delaying the onset or reducing the risk of acquiring a given disease or disorder.

Those in need of treatment may include individuals already having a particular medical disorder, as well as those at risk of having, or who may ultimately acquire the disorder. The need for treatment is assessed, for example, by the presence of one or more risk factors associated with the development of a disorder, the presence or progression of a disorder, or likely receptiveness to treatment of a subject having the disorder. Treating metabolic diseases may encompass reducing or eliminating associated symptoms, e.g., weight gain, and does not necessarily encompass the elimination of the underlying disease or disorder, e.g., congenital leptin deficiency. Treating the diseases described herein may encompass increasing levels of propionate, increasing levels of butyrate, and increasing GLP-1, and/or modulating levels of tryptophan and/or its metabolites (e.g., kynurenine), and does not necessarily encompass the elimination of the underlying disease.

As used herein a "pharmaceutical composition" refers to a preparation of genetically engineered bacteria of the invention with other components such as a physiologically suitable carrier and/or excipient.

The phrases "physiologically acceptable carrier" and "pharmaceutically acceptable carrier" which may be used interchangeably refer to a carrier or a diluent that does not cause significant irritation to an organism and does not abrogate the biological activity and properties of the administered bacterial compound. An adjuvant is included under these phrases.

The term "excipient" refers to an inert substance added to a pharmaceutical composition to further facilitate administration of an active ingredient. Examples include, but are not limited to, calcium bicarbonate, calcium phosphate, various sugars and types of starch, cellulose derivatives, gelatin, vegetable oils, polyethylene glycols, and surfactants, including, for example, polysorbate 20.

The terms "therapeutically effective dose" and "therapeutically effective amount" are used to refer to an amount of a compound that results in prevention, delay of onset of symptoms, or amelioration of symptoms of a condition, e.g., obesity. A therapeutically effective amount may, for example, be sufficient to treat, prevent, reduce the severity, delay the onset, and/or reduce the risk of occurrence of one or more symptoms of a metabolic disease. A therapeutically effective amount, as well as a therapeutically effective frequency of administration, can be determined by methods known in the art and discussed below.

The articles "a" and "an," as used herein, should be understood to mean "at least one," unless clearly indicated to the contrary.

The phrase "and/or," when used between elements in a list, is intended to mean either (1) that only a single listed element is present, or (2) that more than one element of the list is present. For example, "A, B, and/or C" indicates that the selection may be A alone; B alone; C alone; A and B; A and C; B and C; or A, B, and C. The phrase "and/or" may be used interchangeably with "at least one of" or "one or more of" the elements in a list.

Bacteria

The genetically engineered bacteria of the invention comprise a gene or gene cassette for producing a non-native metabolic and/or satiety effector molecule, wherein the gene or gene cassette is operably linked to a directly or indirectly inducible promoter that is controlled by exogenous environmental condition(s). In some embodiments, the genetically engineered bacteria are non-pathogenic bacteria. In some embodiments, the genetically engineered bacteria are commensal bacteria. In some embodiments, the genetically engineered bacteria are probiotic bacteria. In some embodiments, non-pathogenic bacteria are Gram-negative bacteria. In some embodiments, non-pathogenic bacteria are Gram-positive bacteria. In some embodiments, the genetically engineered bacteria are naturally pathogenic bacteria that are modified or mutated to reduce or eliminate pathogenicity. Exemplary bacteria include, but are not limited to *Bacillus*, *Bacteroides*, *Bifidobacterium*, *Brevibacteria*, *Clostridium*, *Enterococcus*, *Escherichia coli*, *Lactobacillus*, *Lactococcus*, *Saccharomyces*, and *Staphylococcus*, e.g., *Bacillus coagulans, Bacillus subtilis, Bacteroides fragilis, Bacteroides subtilis, Bacteroides thetaiotaomicron, Bifidobacterium bifidum, Bifidobacterium infantis, Bifidobacterium lactis, Bifidobacterium longum, Clostridium butyricum, Enterococcus faecium, Lactobacillus acidophilus, Lactobacillus bulgaricus, Lactobacillus casei, Lactobacillus johnsonii, Lactobacillus paracasei, Lactobacillus plantarum, Lactobacillus reuteri, Lactobacillus rhamnosus, Lactococcus lactis*, and *Saccharomyces boulardii*. In certain embodiments, the genetically engineered bacteria are selected from the group consisting of *Bacteroides fragilis, Bacteroides thetaiotaomicron, Bacteroides subtilis, Bifidobacterium bifidum, Bifidobacterium infantis, Bifidobacterium lactis, Clostridium butyricum, Escherichia coli* Nissle, *Lactobacillus acidophilus, Lactobacillus plantarum, Lactobacillus reuteri*, and *Lactococcus lactis*.

In some embodiments, the genetically engineered bacteria are *Escherichia coli* strain Nissle 1917 (*E. coli* Nissle), a Gram-positive bacterium of the Enterobacteriaceae family that "has evolved into one of the best characterized probiotics" (Ukena et al., 2007). The strain is characterized by its complete harmlessness (Schultz, 2008), and has GRAS (generally recognized as safe) status (Reister et al., 2014, emphasis added). Genomic sequencing confirmed that *E. coli* Nissle lacks prominent virulence factors (e.g., *E. coli* α-hemolysin, P-fimbrial adhesins) (Schultz, 2008). In addition, it has been shown that *E. coli* Nissle does not carry pathogenic adhesion factors, does not produce any enterotoxins or cytotoxins, is not invasive, and is not uropathogenic (Sonnenborn et al., 2009). As early as in 1917, *E. coli* Nissle was packaged into medicinal capsules, called Mutaflor, for therapeutic use. *E. coli* Nissle has since been used to treat ulcerative colitis in humans in vivo (Rembacken et al., 1999), to treat inflammatory bowel disease, Crohn's disease, and pouchitis in humans in vivo (Schultz, 2008), and to inhibit enteroinvasive *Salmonella, Legionella, Yersinia*, and *Shigella* in vitro (Altenhoefer et al., 2004). It is commonly accepted that *E. coli* Nissle's "therapeutic efficacy and safety have convincingly been proven" (Ukena et al., 2007). In a recent study in non-human primates, Nissle was well tolerated by female cynomolgus monkeys after 28 days of daily NG dose administration at doses up to $1 \times 10^{12}$ CFU/animal. No Nissle related mortality occurred and no Nissle related effects were identified upon clinical observation, body weight, and clinical pathology assessment (see, e.g., PCT/US16/34200).

One of ordinary skill in the art would appreciate that the genetic modifications disclosed herein may be adapted for other species, strains, and subtypes of bacteria. It is known, for example, that "the clostridial butyrogenic pathway [genes] . . . are widespread in the genome-sequenced clostridia and related species" (Aboulnaga et al., 2013). Furthermore, genes from one or more different species of bacteria can be introduced into one another, e.g., the butyrogenic genes from *Peptoclostridium difficile* have been expressed in *Escherichia coli* (Aboulnaga et al., 2013).

Unmodified *E. coli* Nissle and the genetically engineered bacteria of the invention may be destroyed, e.g., by defense factors in the gut or blood serum (Sonnenborn et al., 2009). Thus the genetically engineered bacteria may require continued administration. Residence time in vivo may be calculated for the genetically engineered bacteria.

In certain embodiments, the payload(s) described below are expressed in one species, strain, or subtype of genetically engineered bacteria. In alternate embodiments, the payload is expressed in two or more species, strains, and/or subtypes of genetically engineered bacteria.

Metabolic Diseases

NASH

Non-alcoholic steatohepatitis (NASH) is a severe form of non-alcoholic fatty liver disease (NAFLD), where excess fat accumulation in the liver results in chronic inflammation and damage. Nonalcoholic fatty liver disease is a component of metabolic syndrome and a spectrum of liver disorders ranging from simple steatosis to nonalcoholic steatohepatitis (NASH). Simple liver steatosis is defined as a benign form of NAFLD with minimal risk of progression, in contrast to NASH, which tends to progress to cirrhosis in up to 20% of patients and can subsequently lead to liver failure or hepatocellular carcinoma. NASH affects approximately 3-5% of the population in America, especially in those identified as obese. NASH is characterized by such abnormalities as advanced lipotoxic metabolites, pro-inflammatory substrate, fibrosis, and increased hepatic lipid deposition. If left untreated, NASH can lead to cirrhosis, liver failure, and hepatocellular carcinoma.

Although patients diagnosed with alcoholic steatohepatitis demonstrate similar symptoms and liver damage, NASH develops in individuals who do not consume alcohol, and the underlying causes of NASH are unknown. Hepatic steatosis occurs when the amount of imported and synthesized lipids exceeds the export or catabolism in hepatocytes. An excess intake of fat or carbohydrate is the main cause of hepatic steatosis. NAFLD patients exhibit signs of liver inflammation and increased hepatic lipid accumulation. In addition, the development of NAFLD in obese individuals is closely associated with insulin resistance and other metabolic disorders and thus might be of clinical relevance). Therefore, Possible causative factors include insulin resistance, cytokine imbalance (specifically, an increase in the tumor necrosis factor-alpha (TNF-α)/adiponectin ratio), and oxidative stress resulting from mitochondrial abnormalities.

Currently, there is no accepted approach to treating NASH. Therapy generally involves treating known risk factors such as correction of obesity through diet and exercise, treating hyperglycemia through diet and insulin, avoiding alcohol consumption, and avoiding unnecessary medication. In animal models, administration of butyrate has been shown to reduce hepatic steatosis, inflammation, and fat deposition (see, for example, Jin et al., British J. Nutrition, 114(11):1745-1755, 2015 and Endo et al., PLoS One, 8(5):e63388, 2013). Colonic propionate delivery has also been shown to reduce intrahepatocellular lipid content in NASH patients, including improvements in weight gain and intra-abdominal fat deposition (see, for example, Chambers et al., Gut, gutjnl-2014), and GLP-1 administration has been shown to reduce the degree of lipotoxic metabolites and pro-inflammatory substrates, both of which have been shown to speed NASH development, as well as reduce hepatic lipid deposition (see, for example, Bernsmeier et al., PLoS One, 9(1):e87488, 2014 and Armstrong et al., J. Hepatol., 2015).

The liver has both an arterial and venous blood supply, with the majority of hepatic blood flow coming from the gut via the portal vein. In NASH the liver is exposed to potentially harmful substances derived from the gut (increased perability and reduced intestinal integrity), including translocated bacteria, LPS and endotoxins as well as secreted cytokines. Translocated microbial products might contribute to the pathogenesis of fatty liver disease by several mechanisms, including stimulating pro-inflammatory and profibrotic pathways via a range of cytokines. For example, butyrate and other SCFA, e.g., derived from the microbiota, are known to promote maintaining intestinal integrity.

The role of bile acids in the pathogenesis of NAFLD and NASH has been extensively studied (Leung et al., The Role Of The Gut Microbiota In NAFLD; Nature Reviews I Gastroenterology & Hepatology). For example, in one study, manipulation of the gut microbiota changed intestinal bile acid composition leading to intestinal antagonism of FRX, the master regulator of bile acid metabolism. This FXR antagonism reduced ceramide synthesis and de novo lipogenesis in the liver (Jiang, C. et al. Intestinal farnesoid X receptor signaling promotes nonalcoholic fatty liver disease. *J. Clin. Invest.* 125, 386-402 (2015)).

Studies have also suggested that rapid weight loss through bariatric surgery (e.g. gastric bypass) is effective in decreasing steatosis, hepatic inflammation, and fibrosis. Other treatments have involved using anti-diabetic medications such as metformin, rosiglitazone, and pioglitazone. Though inconclusive, the studies suggest that the medications stimulate insulin sensitivity in NASH patients, thus alleviating liver damage. In cases were NASH has resulted in advanced cirrhosis, the only treatment is a liver transplant. Regardless, no current treatments are wholly determinative or reliable for treating NASH. Therefore, a need exists for improved therapies and treatments of NASH.

In some embodiments, the genetically engineered bacteria are useful for the prevention, treatment, and/or management of NAFLD and/or NASH. In some embodiments, the genetically engineered bacteria comprise circuits which reduce inflammation. In some embodiments the circuits stimulate insulin secretion and/or promote satiety.

In some embodiments, the genetically engineered bacteria comprise one or more gene cassettes for the production of short-chain fatty acids, e.g., butyrate and/or propionate, and/or acetate. In some embodiments, the genetically engineered bacteria comprise one or more gene cassettes for the production of GLP-1. In some embodiments, the genetically engineered bacteria comprise one or more gene cassettes for the production of short-chain fatty acids, e.g., butyrate and/or propionate for the treatment of NAFLD and/or NASH. In some embodiments, the genetically engineered bacteria comprise one or more gene cassettes for the increase of bile salt catabolism, including but not limited to bile salt hydrolase or bile salt transporter producing cassettes.

In certain embodiments, the genetically engineered bacteria comprise one or more gene cassettes as described herein, which modulate typtophan levels in the patient, e.g., in the serum and/or in the gut. In certain embodiments, the genetically engineered bacteria comprise one or more gene cassettes as described herein, which modulate kynurenine levels in the patient, e.g., in the serum and/or in the gut. In certain embodiments, the genetically engineered bacteria comprise one or more gene cassettes as described herein, which modulate levels of downstream kynurenine metabolites described herein in the patient, e.g., in the serum and/or in the gut. In certain embodiments, the genetically engineered bacteria comprise one or more gene cassettes as described herein, which modulate levels of downstream indole tryptophan metabolites described herein, including, but not limited to those listed in Table 13 and elsewhere herein, in the patient, e.g., in the serum and/or in the gut.

In certain embodiments, the genetically engineered bacteria comprise one or more gene cassettes as described herein, which modulate the TRP/KYN ratio in the patient, e.g., in the serum and/or in the gut. In some embodiments, the genetically engineered bacteria comprise gene cassettes which modulate the ratios of tryptophan to one or more indole tryptophan metabolites, including, but not limited to those listed in Table 13 and elsewhere herein. In some embodiments, the genetically engineered bacteria comprise gene cassettes which modulate the ratios of tryptophan to one or more kynurenine downstream metabolites described herein, e.g., in FIG. 29. In some embodiments, the genetically engineered bacteria comprise gene cassettes which modulate the ratios of kynurenine to one or more tryptophan metabolites, including, but not limited to those listed in Table 13 and elsewhere herein. In some embodiments, the genetically engineered bacteria comprise gene cassettes which modulate the ratios of kynurenine to one or more downstream kynurenine metabolites, including, but not limited to those listed in Table 13 and elsewhere herein. In some embodiments, the genetically engineered bacteria comprise gene cassettes which modulate the ratios between two downstream kynurenine metabolites, including, but not limited to those listed in Table 13 and elsewhere herein. In some embodiments, the genetically engineered bacteria comprise gene cassettes which modulate the ratios between one or more tryptophan metabolites, including, but not limited to those listed in Table 13 and elsewhere herein.

In certain embodiments, the genetically engineered bacteria comprise one or more gene cassettes as described herein, which increase typtophan levels in the patient, e.g., in the serum and/or in the gut. In certain embodiments, the genetically engineered bacteria comprise one or more gene cassettes as described herein, which increase kynurenine levels in the patient, e.g., in the serum and/or in the gut. In certain embodiments, the genetically engineered bacteria comprise one or more gene cassettes as described herein, which increase levels of downstream kynurenine metabolites described herein in the patient, e.g., in the serum and/or in the gut. In certain embodiments, the genetically engineered bacteria comprise one or more gene cassettes as described herein, which increase levels of downstream tryptophan metabolites described herein, including, but not limited to those listed in Table 13 and elsewhere herein, in the patient, e.g., in the serum and/or in the gut.

In certain embodiments, the genetically engineered bacteria comprise one or more gene cassettes as described herein, which increase the TRP/KYN ratio in the patient, e.g., in the serum and/or in the gut. In some embodiments, the genetically engineered bacteria comprise gene cassettes which increase the ratios of tryptophan to one or more tryptophan metabolites, including, but not limited to those listed in Table 13 and elsewhere herein. In some embodiments, the genetically engineered bacteria comprise gene cassettes which increase the ratios of tryptophan to one or more kynurenine downstream metabolites described herein, e.g., in FIG. 29. In some embodiments, the genetically engineered bacteria comprise gene cassettes which increase the ratios of kynurenine to one or more tryptophan metabolites, including, but not limited to those listed in Table 13 and elsewhere herein. In some embodiments, the genetically engineered bacteria comprise gene cassettes which increase the ratios of kynurenine to one or more downstream kynurenine metabolites, including, but not limited to those listed in Table 13 and elsewhere herein. In some embodiments, the genetically engineered bacteria comprise gene cassettes which increase the ratios between two downstream kynurenine metabolites, including, but not limited to those listed in Table 13 and elsewhere herein. In some embodiments, the genetically engineered bacteria comprise gene cassettes which increase the ratios between one or more tryptophan metabolites, including, but not limited to those listed in Table 13 and elsewhere herein.

In certain embodiments, the genetically engineered bacteria comprise one or more gene cassettes as described herein, which decrease typtophan levels in the patient, e.g., in the serum and/or in the gut. In certain embodiments, the genetically engineered bacteria comprise one or more gene cassettes as described herein, which decrease kynurenine levels in the patient, e.g., in the serum and/or in the gut. In certain embodiments, the genetically engineered bacteria comprise one or more gene cassettes as described herein, which decrease levels of downstream kynurenine metabolites described herein in the patient, e.g., in the serum and/or in the gut. In certain embodiments, the genetically engineered bacteria comprise one or more gene cassettes as described herein, which decrease levels of downstream tryptophan metabolites described herein, including, but not limited to those listed in Table 13, and elsewhere herein, in the patient, e.g., in the serum and/or in the gut.

In certain embodiments, the genetically engineered bacteria comprise one or more gene cassettes as described herein, which decrease the TRP/KYN ratio in the patient, e.g., in the serum and/or in the gut. In some embodiments, the genetically engineered bacteria comprise gene cassettes which decrease the ratios of tryptophan to one or more tryptophan metabolites, including, but not limited to those listed in Table 13 and elsewhere herein. In some embodiments, the genetically engineered bacteria comprise gene cassettes which decrease the ratios of tryptophan to one or more kynurenine downstream metabolites described herein, e.g., in FIG. 29. In some embodiments, the genetically engineered bacteria comprise gene cassettes which decrease the ratios of kynurenine to one or more tryptophan metabolites, including, but not limited to those listed in Table 13 and elsewhere herein. In some embodiments, the genetically engineered bacteria comprise gene cassettes which decrease the ratios of kynurenine to one or more downstream kynurenine metabolites, including, but not limited to those listed in Table 13 and elsewhere herein. In some embodiments, the genetically engineered bacteria comprise gene cassettes which decrease the ratios between two downstream kynurenine metabolites, including, but not limited to those listed in Table 13 and elsewhere herein. In some embodiments, the genetically engineered bacteria comprise gene cassettes which decrease the ratios between one or more tryptophan metabolites, including, but not limited to those listed in Table 13 and elsewhere herein.

In some embodiments, the genetically engineered bacteria comprise a gene cassette which modulates serotonin and or melatonin levels. In some embodiments, the genetically engineered bacteria comprise a gene cassette which increases serotonin and or melatonin levels. In some embodiments, the genetically engineered bacteria comprise a gene cassette which decreases serotonin and or melatonin levels. In some embodiments, the genetically engineered bacteria comprise a gene cassette which modulates the tryptophan to serotonin and or melatonin ratios. In some embodiments, the genetically engineered bacteria comprise a gene cassette which increases the tryptophan to serotonin and or melatonin ratios. In some embodiments, the genetically engineered bacteria comprise a gene cassette which decreases the tryptophan to serotonin and or melatonin ratios.

In certain embodiments, one or more of these circuits may be combined for the treatment of NASH and/or NAFLD. In a non-limiting example, butyrate producing, GLP-1 secreting, and ryptophan pathway modulating cassettes may be expressed in combination by the genetically engineered bacteria for the treatment of NASH and/or NAFLD.

Diabetes

Diabetes mellitus type 1 (also known as type 1 diabetes) is a form of diabetes mellitus that results from the autoimmune destruction of the insulin-producing beta cells in the pancreas. The subsequent lack of insulin leads to increased glucose in blood and urine. The classical symptoms are frequent urination, increased thirst, increased hunger, and weight loss. In some embodiments the genetically engineered bacteria described herein are useful in the treatment, prevention and/or management of diabetes mellitus.

Diabetes mellitus type 2 is a long term metabolic disorder that is characterized by high blood sugar, insulin resistance, and relative lack of insulin. Common symptoms include increased thirst, frequent urination, and unexplained weight loss. Symptoms may also include increased hunger, feeling tired, and sores that do not heal. Often symptoms come on slowly. Long-term complications from high blood sugar include heart disease, strokes, diabetic retinopathy which can result in blindness, kidney failure, and poor blood flow in the limbs which may lead to amputations.

Insulin resistance (IR) is generally regarded as a pathological condition in which cells fail to respond to the normal actions of the hormone insulin. Normally insulin produced when glucose enters the circulation after a meal triggers glucose uptake into cells. Under conditions of insulin resistance, the cells in the body are resistant to the insulin produced after a meal, preventing glucose uptake and leading to high blood sugar.

The kynurenine hypothesis of diabetes is based on evidence of diabetogenic effects of the kynurenine metabolite Xanthurenic Acid (XA) and the realization that the KP is upregulated by low-grade inflammation and stress, two conditions involved in the pathogenesis of insulin resistance, and of diabetes type I and diabetes type II. Increased concentrations of KYNA and xanthurenic acid (3-Hydroxy KYNA, XA) were detected in the plasma of patients with type 2 diabetes, presumably due to chronic stress or the low-grade inflammation that are prominent risk factors for diabetes. The production of these kynurenine metabolites is a regulatory mechanism to attenuate damage by the inflammation-induced production of reactive oxygen species.

Experimental and clinical data have clearly established that besides fat, muscle and liver, pancreatic islet tissue itself is a site of inflammation during obesity and type 2 diabetes. It is therefore conceivable that in parallel to the high free fatty acids and glucose levels, pancreatic islet exposure to increased levels of cytokines may induce dysregulation of islet KP in a way resembling that seen in the brain in many neurodegenerative disorders.

In some embodiments, the genetically engineered bacteria are useful for the prevention, treatment, and/or management of type 2 diabetes. In some embodiments, the genetically engineered bacteria comprise circuits which reduce inflammation. In some embodiments the circuits stimulate insulin secretion and/or promote satiety.

In some embodiments, the genetically engineered bacteria comprise one or more gene cassettes for the production of short-chain fatty acids, e.g., butyrate and/or propionate and/or acetate. In some embodiments, the genetically engineered bacteria comprise one or more gene cassettes for the production of GLP-1. In some embodiments, the genetically engineered bacteria comprise one or more gene cassettes for the production of short-chain fatty acids, e.g., butyrate and/or propionate for the treatment of type 2 diabetes. In some embodiments, the genetically engineered bacteria comprise one or more gene cassettes for the increase of bile salt catabolism, including but not limited to bile salt hydrolase or bile salt transporter producing cassettes.

In certain embodiments, the genetically engineered bacteria comprise one or more gene cassettes as described herein, which modulate typtophan levels in the patient, e.g., in the serum and/or in the gut. In certain embodiments, the genetically engineered bacteria comprise one or more gene cassettes as described herein, which modulate kynurenine levels in the patient, e.g., in the serum and/or in the gut. In certain embodiments, the genetically engineered bacteria comprise one or more gene cassettes as described herein, which modulate levels of downstream kynurenine metabolites described herein in the patient, e.g., in the serum and/or in the gut. In certain embodiments, the genetically engineered bacteria comprise one or more gene cassettes as described herein, which modulate levels of downstream tryptophan metabolites described herein, including, but not limited to those listed in Table 13 and elsewhere herein, in the patient, e.g., in the serum and/or in the gut.

In certain embodiments, the genetically engineered bacteria comprise one or more gene cassettes as described herein, which modulate the TRP/KYN ratio in the patient, e.g., in the serum and/or in the gut. In some embodiments, the genetically engineered bacteria comprise gene cassettes which modulate the ratios of tryptophan to one or more tryptophan metabolites, including, but not limited to those listed in Table 13 and elsewhere herein. In some embodiments, the genetically engineered bacteria comprise gene cassettes which modulate the ratios of tryptophan to one or more kynurenine downstream metabolites described herein, e.g., in FIG. 29. In some embodiments, the genetically engineered bacteria comprise gene cassettes which modulate the ratios of kynurenine to one or more tryptophan metabolites, including, but not limited to those listed in Table 13 and elsewhere herein. In some embodiments, the genetically engineered bacteria comprise gene cassettes which modulate the ratios of kynurenine to one or more downstream kynurenine metabolites, including, but not limited to those listed in Table 13 and elsewhere herein. In some embodiments, the genetically engineered bacteria comprise gene cassettes which modulate the ratios between two downstream kynurenine metabolites, including, but not limited to those listed in Table 13 and elsewhere herein. In some embodiments, the genetically engineered bacteria comprise gene cassettes which modulate the ratios between one or more tryptophan metabolites, including, but not limited to those listed in Table 13 and elsewhere herein.

In certain embodiments, the genetically engineered bacteria comprise one or more gene cassettes as described herein, which increase typtophan levels in the patient, e.g., in the serum and/or in the gut. In certain embodiments, the genetically engineered bacteria comprise one or more gene cassettes as described herein, which increase kynurenine levels in the patient, e.g., in the serum and/or in the gut. In certain embodiments, the genetically engineered bacteria comprise one or more gene cassettes as described herein, which increase levels of downstream kynurenine metabolites described herein in the patient, e.g., in the serum and/or in the gut. In certain embodiments, the genetically engineered bacteria comprise one or more gene cassettes as described herein, which increase levels of downstream tryptophan metabolites described herein, including, not limited to those listed in Table 13 and elsewhere herein, in the patient, e.g., in the serum and/or in the gut.

In certain embodiments, the genetically engineered bacteria comprise one or more gene cassettes as described herein, which increase the TRP/KYN ratio in the patient, e.g., in the serum and/or in the gut. In some embodiments, the genetically engineered bacteria comprise gene cassettes which increase the ratios of tryptophan to one or more tryptophan metabolites, including, but not limited to those listed in Table 13 and elsewhere herein. In some embodiments, the genetically engineered bacteria comprise gene cassettes which increase the ratios of tryptophan to one or more kynurenine downstream metabolites described herein, e.g., in FIG. 29. In some embodiments, the genetically engineered bacteria comprise gene cassettes which increase the ratios of kynurenine to one or more tryptophan metabolites, including, but not limited to those listed in Table 13 and elsewhere herein. In some embodiments, the genetically engineered bacteria comprise gene cassettes which increase the ratios of kynurenine to one or more downstream kynurenine metabolites, including, but not limited to those listed in Table 13 and elsewhere herein. In some embodiments, the genetically engineered bacteria comprise gene cassettes which increase the ratios between two downstream kynurenine metabolites, including, but not limited to those listed in Table 13 and elsewhere herein. In some embodiments, the genetically engineered bacteria comprise gene cassettes which increase the ratios between one or more tryptophan metabolites, including, but not limited to those listed in Table 13 and elsewhere herein.

In certain embodiments, the genetically engineered bacteria comprise one or more gene cassettes as described herein, which decrease typtophan levels in the patient, e.g., in the serum and/or in the gut. In certain embodiments, the genetically engineered bacteria comprise one or more gene cassettes as described herein, which decrease kynurenine levels in the patient, e.g., in the serum and/or in the gut. In certain embodiments, the genetically engineered bacteria comprise one or more gene cassettes as described herein, which decrease levels of downstream kynurenine metabolites described herein in the patient, e.g., in the serum and/or in the gut. In certain embodiments, the genetically engineered bacteria comprise one or more gene cassettes as described herein, which decrease levels of downstream tryptophan metabolites described herein, including, but not limited to those listed in Table 13 and elsewhere herein, in the patient, e.g., in the serum and/or in the gut.

In certain embodiments, the genetically engineered bacteria comprise one or more gene cassettes as described herein, which decrease the TRP/KYN ratio in the patient, e.g., in the serum and/or in the gut. In some embodiments, the genetically engineered bacteria comprise gene cassettes which decrease the ratios of tryptophan to one or more tryptophan metabolites, including, but not limited to those listed in Table 13 and elsewhere herein. In some embodiments, the genetically engineered bacteria comprise gene cassettes which decrease the ratios of tryptophan to one or more kynurenine downstream metabolites described herein, e.g., in FIG. 29. In some embodiments, the genetically engineered bacteria comprise gene cassettes which decrease the ratios of kynurenine to one or more tryptophan metabolites, including, but not limited to those listed in Table 13 and elsewhere herein. In some embodiments, the genetically engineered bacteria comprise gene cassettes which decrease the ratios of kynurenine to one or more downstream kynurenine metabolites, including, but not limited to those listed in Table 13 and elsewhere herein. In some embodiments, the genetically engineered bacteria comprise gene cassettes which decrease the ratios between two downstream kynurenine metabolites, including, but not limited to those listed in Table 13 and elsewhere herein. In some embodiments, the genetically engineered bacteria comprise gene cassettes which decrease the ratios between one or more tryptophan metabolites, including, but not limited to those listed in Table 13 and elsewhere herein.

In some embodiments, the genetically engineered bacteria comprise a gene cassette which modulates serotonin and or melatonin levels. In some embodiments, the genetically engineered bacteria comprise a gene cassette which increases serotonin and or melatonin levels. In some embodiments, the genetically engineered bacteria comprise a gene cassette which decreases serotonin and or melatonin levels. In some embodiments, the genetically engineered bacteria comprise a gene cassette which modulates the tryptophan to serotonin and or melatonin ratios. In some embodiments, the genetically engineered bacteria comprise a gene cassette which increases the tryptophan to serotonin and or melatonin ratios. In some embodiments, the genetically engineered bacteria comprise a gene cassette which decreases the tryptophan to serotonin and or melatonin ratios.

In certain embodiments, one or more of these circuits may be combined for the treatment of type 2 diabetes. In a non-limiting example, butyrate producing, GLP-1 secreting, and ryptophan pathway modulating cassettes may be expressed in combination by the genetically engineered bacteria for the treatment of type 2 diabetes.

Obesity

Metabolic Syndrome affects approximately 20-30% of the middle-aged population, and represents an increased risk to cardiovascular disorders, the leading cause of death in the United States. Obesity, dyslipidemia, hypertension, and type 2 diabetes are described as metabolic syndrome. In some embodiments the genetically engineered bacteria described herein are useful in the treatment, prevention and/or management of metabolic syndrome and/or obesity. Several of the metabolites and polypeptides produced by the genetically engineered bacteria are useful for increasing insulin secretion and promoting satiety, e.g. GLP-1.

Obesity is a common, deadly, and costly disease in developed countries which impacts all age groups, race, and gender. Obesity can be classified as an inflammatory disease because it is associated with immune activation and a chronic, low-grade systemic inflammation. Endotoxemia, a process resulting from translocation of endotoxic compounds (lipopolysaccharides [LPS]), of gram-negative intestinal bacteria. In the last decade, it has become evident that insulin resistance and T2DM are characterized by low-grade inflammation. In this respect, LPS trigger a low-grade inflammatory response, and the process of endotoxemia can therefore result in the development of insulin resistance and other metabolic disorders. Several of the metabolites produced by the genetically engineered bacteria described herein are useful in the reduction of inflammation. For example, butyrate, contributes to maintaining intestinal integrity. Other anti-inflammatory metabolites as described herein may also be useful in the treatment of type 2 diaberes.

Over nutrition leads to an excess intake of tryptophan (TRP)—an essential amino acid, a precursor for serotonin (5-HT) and melatonin, and a key player in the caloric intake regulation. Yet, the circulating levels of TRP have been shown to be low in morbidly obese subjects (Brandacher G, Winkler C, Aigner F, et al. Bariatric surgery cannot prevent tryptophan depletion due to chronic immune activation in morbidly obese patients. Obes Surg 2006; 16:541-548).

Serotonin regulates carbohydrate and fat intake (Blundell J E, Lawton C L. Serotonin and dietary fat intake: effects of dexfenfluramine. Metabolism 1995; 44:33-37), relieves stress which is another caloric intake trigger (Buwalda B, Blom W A, Koolhaas J M, van Dijk G. Behavioral and physiological responses to stress are affected by high-fat feeding in male rats; Physiol Behav 2001; 73:371-377), and inhibits neuropeptide Y (NYP)—one of the most potent orexigenic peptides in the hypothalamus (Jia Y, El-Haddad M, Gendy A, Nguyen T, Ross M G.

In some embodiments, the genetically engineered bacteria are useful for the prevention, treatment, and/or management of obesity. In some embodiments, the genetically engineered bacteria comprise circuits which reduce inflammation. In some embodiments the circuits stimulate insulin secretion and/or promote satiety.

In some embodiments, the genetically engineered bacteria comprise one or more gene cassettes for the production of short-chain fatty acids, e.g., butyrate and/or propionate and/or acetate. In some embodiments, the genetically engineered bacteria comprise one or more gene cassettes for the production of GLP-1 and/or GLP-1 analog(s). In some embodiments, the genetically engineered bacteria comprise one or more gene cassettes for the production of short-chain fatty acids, e.g., butyrate and/or propionate for the treatment of obesity. In some embodiments, the genetically engineered bacteria comprise one or more gene cassettes for the increase of bile salt catabolism, including, but not limited, to bile salt hydrolase or bile salt transporter producing cassettes.

In certain embodiments, the genetically engineered bacteria comprise one or more gene cassettes as described herein, which modulate typtophan levels in the patient, e.g., in the serum and/or in the gut. In certain embodiments, the genetically engineered bacteria comprise one or more gene cassettes as described herein, which modulate kynurenine levels in the patient, e.g., in the serum and/or in the gut. In certain embodiments, the genetically engineered bacteria comprise one or more gene cassettes as described herein, which modulate levels of downstream kynurenine metabolites described herein in the patient, e.g., in the serum and/or in the gut. In certain embodiments, the genetically engineered bacteria comprise one or more gene cassettes as described herein, which modulate levels of downstream tryptophan metabolites described herein, including, but not limited to those listed in Table 13 and elsewhere herein, in the patient, e.g., in the serum and/or in the gut.

In certain embodiments, the genetically engineered bacteria comprise one or more gene cassettes as described herein, which modulate the TRP/KYN ratio in the patient, e.g., in the serum and/or in the gut. In some embodiments, the genetically engineered bacteria comprise gene cassettes which modulate the ratios of tryptophan to one or more tryptophan metabolites, including, but not limited to those listed in Table 13, and elsewhere herein, including but not limited to, Tryptamine, Indole-3-acetaldehyde, Indole-3-acetic acid, Indole, 6-formylindolo(3,2-b)carbazole, Kynurenic acid, Indole-3-aldehyde; 3,3'-Diindolylmethane. In some embodiments, the genetically engineered bacteria comprise gene cassettes which modulate the ratios of tryptophan to one or more kynurenine downstream metabolites described herein, e.g., in FIG. 29. In some embodiments, the genetically engineered bacteria comprise gene cassettes which modulate the ratios of kynurenine to one or more tryptophan metabolites, including, but not limited to those listed in Table 13 and FIG. 32 and elsewhere herein. In some embodiments, the genetically engineered bacteria comprise gene cassettes which modulate the ratios of kynurenine to one or more downstream kynurenine metabolites, including, but not limited to those listed in Table 13 and FIG. 32 and elsewhere herein. In some embodiments, the genetically engineered bacteria comprise gene cassettes which modulate the ratios between two downstream kynurenine metabolites, including, but not limited to those listed in Table 13 and FIG. 32 and elsewhere herein. In some embodiments, the genetically engineered bacteria comprise gene cassettes which modulate the ratios between one or more tryptophan metabolites, including, but not limited to those listed in Table 13 and FIG. 32 and elsewhere herein.

In certain embodiments, the genetically engineered bacteria comprise one or more gene cassettes as described herein, which increase typtophan levels in the patient, e.g., in the serum and/or in the gut. In certain embodiments, the genetically engineered bacteria comprise one or more gene cassettes as described herein, which increase kynurenine levels in the patient, e.g., in the serum and/or in the gut. In certain embodiments, the genetically engineered bacteria comprise one or more gene cassettes as described herein, which increase levels of downstream kynurenine metabolites described herein in the patient, e.g., in the serum and/or in the gut. In certain embodiments, the genetically engineered bacteria comprise one or more gene cassettes as described herein, which increase levels of downstream tryptophan metabolites described herein, including, but not limited to those listed in Table 13 and FIG. 32 and elsewhere herein, in the patient, e.g., in the serum and/or in the gut.

In certain embodiments, the genetically engineered bacteria comprise one or more gene cassettes as described herein, which increase the TRP/KYN ratio in the patient, e.g., in the serum and/or in the gut. In some embodiments, the genetically engineered bacteria comprise gene cassettes which increase the ratios of tryptophan to one or more tryptophan metabolites, including, but not limited to those listed in Table 13 and FIG. 32 and elsewhere herein. In some embodiments, the genetically engineered bacteria comprise gene cassettes which increase the ratios of tryptophan to one or more kynurenine downstream metabolites described herein, e.g., in FIG. 29. In some embodiments, the genetically engineered bacteria comprise gene cassettes which increase the ratios of kynurenine to one or more tryptophan metabolites, including, but not limited to those listed in Table 13 and FIG. 32 and elsewhere herein. In some embodiments, the genetically engineered bacteria comprise gene cassettes which increase the ratios of kynurenine to one or more downstream kynurenine metabolites, including, but not limited to those listed in Table 13 and FIG. 32 and elsewhere herein. In some embodiments, the genetically engineered bacteria comprise gene cassettes which increase the ratios between two downstream kynurenine metabolites, including, but not limited to those listed in Table 13 and FIG. 32 and elsewhere herein. In some embodiments, the genetically engineered bacteria comprise gene cassettes which increase the ratios between one or more tryptophan metabolites, including, but not limited to those listed in Table 13 and elsewhere herein.

In certain embodiments, the genetically engineered bacteria comprise one or more gene cassettes as described herein, which decrease typtophan levels in the patient, e.g., in the serum and/or in the gut. In certain embodiments, the genetically engineered bacteria comprise one or more gene cassettes as described herein, which decrease kynurenine levels in the patient, e.g., in the serum and/or in the gut. In certain embodiments, the genetically engineered bacteria comprise one or more gene cassettes as described herein, which decrease levels of downstream kynurenine metabolites described herein in the patient, e.g., in the serum and/or in the gut. In certain embodiments, the genetically engineered bacteria comprise one or more gene cassettes as described herein, which decrease levels of downstream tryptophan metabolites described herein, including, but not limited to those listed in Table 13 and FIG. 32 and elsewhere herein, in the patient, e.g., in the serum and/or in the gut.

In certain embodiments, the genetically engineered bacteria comprise one or more gene cassettes as described herein, which decrease the TRP/KYN ratio in the patient, e.g., in the serum and/or in the gut. In some embodiments, the genetically engineered bacteria comprise gene cassettes which decrease the ratios of tryptophan to one or more tryptophan metabolites, including, but not limited to those listed in Table 13 and FIG. 32 and elsewhere herein. In some embodiments, the genetically engineered bacteria comprise gene cassettes which decrease the ratios of tryptophan to one or more kynurenine downstream metabolites described herein, e.g., in FIG. 29. In some embodiments, the genetically engineered bacteria comprise gene cassettes which decrease the ratios of kynurenine to one or more tryptophan metabolites, including, but not limited to those listed in Table 13 and FIG. 32 and elsewhere herein. In some embodiments, the genetically engineered bacteria comprise gene cassettes which decrease the ratios of kynurenine to one or more downstream kynurenine metabolites, including, but not limited to those listed in Table 13 and FIG. 32 and elsewhere herein. In some embodiments, the genetically engineered bacteria comprise gene cassettes which decrease the ratios between two downstream kynurenine metabolites, including, but not limited to those listed in Table 13 and FIG. 32 and elsewhere herein. In some embodiments, the genetically engineered bacteria comprise gene cassettes which decrease the ratios between one or more tryptophan metabolites, including, but not limited to those listed in Table 13 and FIG. 32 and elsewhere herein.

In some embodiments, the genetically engineered bacteria comprise a gene cassette which modulates serotonin and or melatonin levels. In some embodiments, the genetically engineered bacteria comprise a gene cassette which increases serotonin and or melatonin levels. In some embodiments, the genetically engineered bacteria comprise a gene cassette which decreases serotonin and or melatonin levels. In some embodiments, the genetically engineered bacteria comprise a gene cassette which modulates the tryptophan to serotonin and or melatonin ratios. In some embodiments, the genetically engineered bacteria comprise a gene cassette which increases the tryptophan to serotonin and or melatonin ratios. In some embodiments, the genetically engineered bacteria comprise a gene cassette which decreases the tryptophan to serotonin and or melatonin ratios.

In certain embodiments, one or more of these circuits may be combined for the treatment of obesity. In a non-limiting example, butyrate producing, GLP-1 secreting, and ryptophan pathway modulating cassettes may be expressed in combination by the genetically engineered bacteria for the treatment of obesity.

Prader Willi Syndrome

Prader-Willi syndrome (OMIM 176270) is a complex genetic neurodevelopmental disorder with manifested early in failure to thrive, feeding difficulties during infancy, hypogonadism/hypogenitalism, growth hormone deficiency, and typically a paternal 15q11-q13 chromosome deletion. In early childhood trough alduhood, food seeking behaviors and hyperphagia are noted along with a low metabolic rate and decreased physical activity leading to obesity which can be life-threatening, if not controlled. PWS is considered the most common syndromic cause of life threatening obesity in childhood (Buttler et al., Am J Med Genet A. 2015 March; 167A(3):563-71; Increased plasma chemokine levels in children with Prader-Willi syndrome). It has been reported that, when matched for body mass index (BMI), PWS adults had the same prevalence of metabolic syndrome (41.4%) and insulin resistance index as obese controls.

Prader-Willi syndrome (PWS) has no cure. PWS syndrome individuals present with obesity with hyperphagia and deficit of satiety, and in some cases insulin resistance, that persists throughout youth and adulthood and remains a critical problem in PWS teenagers and adults because it leads to severe complications, such as limb edema, cardiac or respiratory failure, and physical disabilities. Severe obesity, and food seeking therefore remains the larges problem with PWS. Access to food must be strictly supervised and limited. Therefore, agents which modulate satiety and orh insulin levels may be useful in the treatment of PWS.

In additional, increased inflammatory markers and cytokine levels in the plasma have been observed in PWS individuals. These cytokines serve as chemoattractants for recruitment of immune cells and indicate an inflammatory component in PWS, which underlies certain aspects of the pathology (Buttler et al., Am J Med Genet A. 2015 March; 167A(3):563-71; Increased plasma chemokine levels in children with Prader-Willi syndrome). Therefore, anti-inflammatory agents may be useful in the treatment of certain aspects of PWS.

In some embodiments, the genetically engineered bacteria comprise circuits which reduce inflammation. In some embodiments the circuits stimulate insulin secretion and/or promote satiety.

In some embodiments, the genetically engineered bacteria are useful for the prevention, treatment, and/or management of PWS. In some embodiments, the genetically engineered bacteria comprise one or more gene cassettes for the production of short-chain fatty acids, e.g., butyrate and/or propionate and/or acetate. In some embodiments, the genetically engineered bacteria comprise one or more gene cassettes for the production of GLP-1. In some embodiments, the genetically engineered bacteria comprise one or more gene cassettes for the production of short-chain fatty acids, e.g., butyrate and/or propionate for the treatment of PWS. In some embodiments, the genetically engineered bacteria comprise one or more gene cassettes for the increase of bile salt catabolism, including but not limited to bile salt hydrolase or bile salt transporter producing cassettes.

In certain embodiments, the genetically engineered bacteria comprise one or more gene cassettes as described herein, which modulate typtophan levels in the patient, e.g., in the serum and/or in the gut. In certain embodiments, the genetically engineered bacteria comprise one or more gene cassettes as described herein, which modulate kynurenine levels in the patient, e.g., in the serum and/or in the gut. In certain embodiments, the genetically engineered bacteria comprise one or more gene cassettes as described herein, which modulate levels of downstream kynurenine metabolites described herein in the patient, e.g., in the serum and/or in the gut. In certain embodiments, the genetically engineered bacteria comprise one or more gene cassettes as described herein, which modulate levels of downstream tryptophan metabolites described herein, including, but not limited to those listed in Table 13 and FIG. 32 and elsewhere herein, in the patient, e.g., in the serum and/or in the gut.

In certain embodiments, the genetically engineered bacteria comprise one or more gene cassettes as described herein, which modulate the TRP/KYN ratio in the patient, e.g., in the serum and/or in the gut. In some embodiments, the genetically engineered bacteria comprise gene cassettes which modulate the ratios of tryptophan to one or more tryptophan metabolites, including, but not limited to those listed in Table 13 and FIG. 32 and elsewhere herein. In some embodiments, the genetically engineered bacteria comprise gene cassettes which modulate the ratios of tryptophan to one or more kynurenine downstream metabolites described herein, e.g., in FIG. 29. In some embodiments, the genetically engineered bacteria comprise gene cassettes which modulate the ratios of kynurenine to one or more tryptophan metabolites, including, but not limited to those listed in Table 13 and FIG. 32 and elsewhere herein. In some embodiments, the genetically engineered bacteria comprise gene cassettes which modulate the ratios of kynurenine to one or more downstream kynurenine metabolites, including, but not limited to those listed in Table 13 and FIG. 32 and elsewhere herein. In some embodiments, the genetically engineered bacteria comprise gene cassettes which modulate the ratios between two downstream kynurenine metabolites, including, but not limited to those listed in Table 13 and FIG. 32 and elsewhere herein. In some embodiments, the genetically engineered bacteria comprise gene cassettes which modulate the ratios between one or more tryptophan metabolites, including, but not limited to those listed in Table 13 and FIG. 32 and elsewhere herein.

In certain embodiments, the genetically engineered bacteria comprise one or more gene cassettes as described herein, which increase typtophan levels in the patient, e.g., in the serum and/or in the gut. In certain embodiments, the genetically engineered bacteria comprise one or more gene cassettes as described herein, which increase kynurenine levels in the patient, e.g., in the serum and/or in the gut. In certain embodiments, the genetically engineered bacteria comprise one or more gene cassettes as described herein, which increase levels of downstream kynurenine metabolites described herein in the patient, e.g., in the serum and/or in the gut. In certain embodiments, the genetically engineered bacteria comprise one or more gene cassettes as described herein, which increase levels of downstream tryptophan metabolites described herein, including, but not limited to those listed in Table 13 and FIG. 32 and elsewhere herein, in the patient, e.g., in the serum and/or in the gut.

In certain embodiments, the genetically engineered bacteria comprise one or more gene cassettes as described herein, which increase the TRP/KYN ratio in the patient, e.g., in the serum and/or in the gut. In some embodiments, the genetically engineered bacteria comprise gene cassettes which increase the ratios of tryptophan to one or more tryptophan metabolites, including, but not limited to those listed in Table 13 and FIG. 32 and elsewhere herein. In some embodiments, the genetically engineered bacteria comprise gene cassettes which increase the ratios of tryptophan to one or more kynurenine downstream metabolites described herein, e.g., in FIG. 29. In some embodiments, the genetically engineered bacteria comprise gene cassettes which increase the ratios of kynurenine to one or more tryptophan metabolites, including, but not limited to those listed in Table 13 and FIG. 32 and elsewhere herein. In some embodiments, the genetically engineered bacteria comprise gene cassettes which increase the ratios of kynurenine to one or more downstream kynurenine metabolites, including, but not limited to those listed in Table 13 and FIG. 32 and elsewhere herein. In some embodiments, the genetically engineered bacteria comprise gene cassettes which increase the ratios between two downstream kynurenine metabolites, including, but not limited to those listed in Table 13 and FIG. 32 and elsewhere herein. In some embodiments, the genetically engineered bacteria comprise gene cassettes which increase the ratios between one or more tryptophan metabolites, including, but not limited to those listed in Table 13 and FIG. 32 and elsewhere herein.

In certain embodiments, the genetically engineered bacteria comprise one or more gene cassettes as described herein, which decrease typtophan levels in the patient, e.g., in the serum and/or in the gut. In certain embodiments, the genetically engineered bacteria comprise one or more gene cassettes as described herein, which decrease kynurenine levels in the patient, e.g., in the serum and/or in the gut. In certain embodiments, the genetically engineered bacteria comprise one or more gene cassettes as described herein, which decrease levels of downstream kynurenine metabolites described herein in the patient, e.g., in the serum and/or in the gut. In certain embodiments, the genetically engineered bacteria comprise one or more gene cassettes as described herein, which decrease levels of downstream tryptophan metabolites described herein, including, but not limited to those listed in Table 13 and FIG. 32 and elsewhere herein, in the patient, e.g., in the serum and/or in the gut.

In certain embodiments, the genetically engineered bacteria comprise one or more gene cassettes as described herein, which decrease the TRP/KYN ratio in the patient, e.g., in the serum and/or in the gut. In some embodiments, the genetically engineered bacteria comprise gene cassettes which decrease the ratios of tryptophan to one or more tryptophan metabolites, including, but not limited to those listed in Table 13 and FIG. 32 and elsewhere herein. In some embodiments, the genetically engineered bacteria comprise gene cassettes which decrease the ratios of tryptophan to one or more kynurenine downstream metabolites described herein, e.g., in FIG. 29. In some embodiments, the genetically engineered bacteria comprise gene cassettes which decrease the ratios of kynurenine to one or more tryptophan metabolites, including, but not limited to those listed in Table 13 and FIG. 32 and elsewhere herein. In some embodiments, the genetically engineered bacteria comprise gene cassettes which decrease the ratios of kynurenine to one or more downstream kynurenine metabolites, including, but not limited to those listed in Table 13 and FIG. 32 and elsewhere herein. In some embodiments, the genetically engineered bacteria comprise gene cassettes which decrease the ratios between two downstream kynurenine metabolites, including, but not limited to those listed in Table 13 and FIG. 32 and elsewhere herein. In some embodiments, the genetically engineered bacteria comprise gene cassettes which decrease the ratios between one or more tryptophan metabolites, including, but not limited to those listed in Table 13 and FIG. 32 and elsewhere herein.

In some embodiments, the genetically engineered bacteria comprise a gene cassette which modulates serotonin and or melatonin levels. In some embodiments, the genetically engineered bacteria comprise a gene cassette which increases serotonin and or melatonin levels. In some embodiments, the genetically engineered bacteria comprise a gene cassette which decreases serotonin and or melatonin levels. In some embodiments, the genetically engineered bacteria comprise a gene cassette which modulates the tryptophan to serotonin and or melatonin ratios. In some embodiments, the genetically engineered bacteria comprise a gene cassette which increases the tryptophan to serotonin and or melatonin ratios. In some embodiments, the genetically engineered bacteria comprise a gene cassette which decreases the tryptophan to serotonin and or melatonin ratios.

In certain embodiments, one or more of these circuits may be combined for the treatment of PWS. In a non-limiting example, butyrate producing, GLP-1 secreting, and ryptophan pathway modulating cassettes may be expressed in combination by the genetically engineered bacteria for the treatment of PWS.

Metabolic Syndrome

Metabolic syndrome is a clustering of at least three of five of the following medical conditions: abdominal (central)

obesity, elevated blood pressure, elevated fasting plasma glucose, high serum triglycerides, and low high-density lipoprotein (HDL) levels.

In some embodiments, the genetically engineered bacteria are useful for the prevention, treatment, and/or management of metabolic syndrome. In some embodiments, the genetically engineered bacteria comprise circuits which reduce inflammation. In some embodiments the circuits stimulate insulin secretion and/or promote satiety.

In some embodiments, the genetically engineered bacteria comprise one or more gene cassettes for the production of short-chain fatty acids, e.g., butyrate and/or propionate, and/or acetate. In some embodiments, the genetically engineered bacteria comprise one or more gene cassettes for the production of GLP-1. In some embodiments, the genetically engineered bacteria comprise one or more gene cassettes for the production of short-chain fatty acids, e.g., butyrate and/or propionate for the treatment of metabolic syndrome. In some embodiments, the genetically engineered bacteria comprise one or more gene cassettes for the increase of bile salt catabolism, including but not limited to bile salt hydrolase or bile salt transporter producing cassettes.

In certain embodiments, the genetically engineered bacteria comprise one or more gene cassettes as described herein, which modulate typtophan levels in the patient, e.g., in the serum and/or in the gut. In certain embodiments, the genetically engineered bacteria comprise one or more gene cassettes as described herein, which modulate kynurenine levels in the patient, e.g., in the serum and/or in the gut. In certain embodiments, the genetically engineered bacteria comprise one or more gene cassettes as described herein, which modulate levels of downstream kynurenine metabolites described herein in the patient, e.g., in the serum and/or in the gut. In certain embodiments, the genetically engineered bacteria comprise one or more gene cassettes as described herein, which modulate levels of downstream tryptophan metabolites described herein, including, but not limited to those listed in Table 13 and FIG. 32 and elsewhere herein, in the patient, e.g., in the serum and/or in the gut.

In certain embodiments, the genetically engineered bacteria comprise one or more gene cassettes as described herein, which modulate the TRP/KYN ratio in the patient, e.g., in the serum and/or in the gut. In some embodiments, the genetically engineered bacteria comprise gene cassettes which modulate the ratios of tryptophan to one or more tryptophan metabolites, including, but not limited to those listed in Table 13 and FIG. 32 and elsewhere herein. In some embodiments, the genetically engineered bacteria comprise gene cassettes which modulate the ratios of tryptophan to one or more kynurenine downstream metabolites described herein, e.g., in FIG. 29. In some embodiments, the genetically engineered bacteria comprise gene cassettes which modulate the ratios of kynurenine to one or more tryptophan metabolites, including, but not limited to those listed in Table 13 and FIG. 32 and elsewhere herein. In some embodiments, the genetically engineered bacteria comprise gene cassettes which modulate the ratios of kynurenine to one or more downstream kynurenine metabolites, including, but not limited to those listed in Table 13 and FIG. 32 and elsewhere herein. In some embodiments, the genetically engineered bacteria comprise gene cassettes which modulate the ratios between two downstream kynurenine metabolites, including, but not limited to those listed in Table 13 and FIG. 32 and elsewhere herein. In some embodiments, the genetically engineered bacteria comprise gene cassettes which modulate the ratios between one or more tryptophan metabolites, including, but not limited to those listed in Table 13 and FIG. 32 and elsewhere herein.

In certain embodiments, the genetically engineered bacteria comprise one or more gene cassettes as described herein, which increase typtophan levels in the patient, e.g., in the serum and/or in the gut. In certain embodiments, the genetically engineered bacteria comprise one or more gene cassettes as described herein, which increase kynurenine levels in the patient, e.g., in the serum and/or in the gut. In certain embodiments, the genetically engineered bacteria comprise one or more gene cassettes as described herein, which increase levels of downstream kynurenine metabolites described herein in the patient, e.g., in the serum and/or in the gut. In certain embodiments, the genetically engineered bacteria comprise one or more gene cassettes as described herein, which increase levels of downstream tryptophan metabolites described herein, including, but not limited to those listed in Table 13 and FIG. 32 and elsewhere herein, in the patient, e.g., in the serum and/or in the gut.

In certain embodiments, the genetically engineered bacteria comprise one or more gene cassettes as described herein, which increase the TRP/KYN ratio in the patient, e.g., in the serum and/or in the gut. In some embodiments, the genetically engineered bacteria comprise gene cassettes which increase the ratios of tryptophan to one or more tryptophan metabolites, including, but not limited to those listed in Table 13 and FIG. 32 and elsewhere herein. In some embodiments, the genetically engineered bacteria comprise gene cassettes which increase the ratios of tryptophan to one or more kynurenine downstream metabolites described herein, e.g., in FIG. 29. In some embodiments, the genetically engineered bacteria comprise gene cassettes which increase the ratios of kynurenine to one or more tryptophan metabolites, including, but not limited to those listed in Table 13 and FIG. 32 and elsewhere herein. In some embodiments, the genetically engineered bacteria comprise gene cassettes which increase the ratios of kynurenine to one or more downstream kynurenine metabolites, including, but not limited to those listed in Table 13 and FIG. 32 and elsewhere herein. In some embodiments, the genetically engineered bacteria comprise gene cassettes which increase the ratios between two downstream kynurenine metabolites, including, but not limited to those listed in Table 13 and FIG. 32 and elsewhere herein. In some embodiments, the genetically engineered bacteria comprise gene cassettes which increase the ratios between one or more tryptophan metabolites, including, but not limited to those listed in Table 13 and FIG. 32 and elsewhere herein.

In certain embodiments, the genetically engineered bacteria comprise one or more gene cassettes as described herein, which decrease typtophan levels in the patient, e.g., in the serum and/or in the gut. In certain embodiments, the genetically engineered bacteria comprise one or more gene cassettes as described herein, which decrease kynurenine levels in the patient, e.g., in the serum and/or in the gut. In certain embodiments, the genetically engineered bacteria comprise one or more gene cassettes as described herein, which decrease levels of downstream kynurenine metabolites described herein in the patient, e.g., in the serum and/or in the gut. In certain embodiments, the genetically engineered bacteria comprise one or more gene cassettes as described herein, which decrease levels of downstream tryptophan metabolites described herein, including, but not limited to those listed in Table 13 and FIG. 32 and elsewhere herein, in the patient, e.g., in the serum and/or in the gut.

In certain embodiments, the genetically engineered bacteria comprise one or more gene cassettes as described herein, which decrease the TRP/KYN ratio in the patient, e.g., in the serum and/or in the gut. In some embodiments, the genetically engineered bacteria comprise gene cassettes which decrease the ratios of tryptophan to one or more tryptophan metabolites, including, but not limited to those listed in Table 13 and FIG. 32 and elsewhere herein. In some embodiments, the genetically engineered bacteria comprise gene cassettes which decrease the ratios of tryptophan to one or more kynurenine downstream metabolites described herein, e.g., in FIG. 29. In some embodiments, the genetically engineered bacteria comprise gene cassettes which decrease the ratios of kynurenine to one or more tryptophan metabolites, including, but not limited to those listed in Table 13 and FIG. 32 and elsewhere herein. In some embodiments, the genetically engineered bacteria comprise gene cassettes which decrease the ratios of kynurenine to one or more downstream kynurenine metabolites, including, but not limited to those listed in Table 13 and FIG. 32 and elsewhere herein. In some embodiments, the genetically engineered bacteria comprise gene cassettes which decrease the ratios between two downstream kynurenine metabolites, including, but not limited to those listed in Table 13 and FIG. 32 and elsewhere herein. In some embodiments, the genetically engineered bacteria comprise gene cassettes which decrease the ratios between one or more tryptophan metabolites, including, but not limited to those listed in Table 13 and FIG. 32 and elsewhere herein. In some embodiments, the genetically engineered bacteria comprise a gene cassette which modulates serotonin and or melatonin levels. In some embodiments, the genetically engineered bacteria comprise a gene cassette which increases serotonin and or melatonin levels. In some embodiments, the genetically engineered bacteria comprise a gene cassette which decreases serotonin and or melatonin levels. In some embodiments, the genetically engineered bacteria comprise a gene cassette which modulates the tryptophan to serotonin and or melatonin ratios. In some embodiments, the genetically engineered bacteria comprise a gene cassette which increases the tryptophan to serotonin and or melatonin ratios. In some embodiments, the genetically engineered bacteria comprise a gene cassette which decreases the tryptophan to serotonin and or melatonin ratios.

In certain embodiments, one or more of these circuits may be combined for the treatment of metabolic syndrome. In a non-limiting example, butyrate producing, GLP-1 secreting, and ryptophan pathway modulating cassettes may be expressed in combination by the genetically engineered bacteria for the treatment of metabolic syndrome.

Cardiovascular Disease

Metabolic syndrome is an important risk factor for cardiovascular disease incidence and mortality, as well as all-cause mortality.

Cardiovascular disease includes coronary artery diseases (CAD) such as angina and myocardial infarction, stroke, hypertensive heart disease, rheumatic heart disease, cardiomyopathy, heart arrhythmia, congenital heart disease, valvular heart disease, carditis, aortic aneurysms, peripheral artery disease, and venous thrombosis. Coronary artery disease, stroke, and peripheral artery disease involve atherosclerosis, caused inter alia by high blood pressure, smoking, diabetes, lack of exercise, obesity, high blood cholesterol, poor diet, and excessive alcohol consumption, and the like.

The detection, prevention, and treatment of the underlying risk factors of the metabolic syndrome are a critical approach to lower the cardiovascular disease incidence in the general population.

Cellular adhesion molecules and oxidative stress play a role in the pathogenesis of atherosclerosis in patients with chronic kidney disease (CKD) and uremia. Uremia is condition that occurs when the kidneys no longer filter properly, and is likely to occur s in the final stage of chronic kidney disease. Several studies in CKD patients have shown that tryptophan metabolites along the kynurenine pathway are increased, possibly as consequence of inflammation. Therefore, anti-inflammatory agents may be useful in the treatment of cardiovascular disease, including CKD and artherosclerosis. In some embodiments the genetically engineered bacteria modulate the levels of one or more of tryptophan, kynurenine, kynurenine downstream metabolites, and other tryptophan metabolites and/or modulate one or more metabolite ratios.

Ischemic stroke, which results from cerebral arterial occlusion, is becoming a major cause of morbidity and mortality in today's society and affects millions of people every year. Currently, the only approved treatment for the acute phase of stroke is the recombinant thrombolytic tissue-type plasminogen activator. Identifying molecules that contribute to the ischemic damage may help to elucidate potential therapeutic targets. In some embodiments the genetically engineered bacteria described herein are useful in the treatment, prevention and/or management of ischemia and stroke. Inflammation and oxidative stress are also involved in brain damage following stroke, and tryptophan oxidation along the kynurenine pathway contributes to the modulation of oxidative stress.

In some embodiments, the genetically engineered bacteria are useful for the prevention, treatment, and/or management of cardiovascular disease, including but not limited to, one or more of coronary artery diseases, hypertensive heart disease, rheumatic heart disease, cardiomyopathy, heart arrhythmia, congenital heart disease, valvular heart disease, carditis, aortic aneurysms, peripheral artery disease, venous thrombosis, ischemic stroke, and/or chronic kidney disease. In some embodiments, the genetically engineered bacteria comprise circuits which reduce inflammation. In some embodiments the circuits stimulate insulin secretion and/or promote satiety.

In some embodiments, the genetically engineered bacteria comprise one or more gene cassettes for the production of short-chain fatty acids, e.g., butyrate and/or propionate and/or acetate. In some embodiments, the genetically engineered bacteria comprise one or more gene cassettes for the production of GLP-1. In some embodiments, the genetically engineered bacteria comprise one or more gene cassettes for the production of short-chain fatty acids, e.g., butyrate and/or propionate for the treatment of cardiovascular disease, including but not limited to, one or more of coronary artery diseases, hypertensive heart disease, rheumatic heart disease, cardiomyopathy, heart arrhythmia, congenital heart disease, valvular heart disease, carditis, aortic aneurysms, peripheral artery disease, venous thrombosis, ischemic stroke, and/or chronic kidney disease.

In some embodiments, the genetically engineered bacteria comprise one or more gene cassettes for the increase of bile salt catabolism, including but not limited to bile salt hydrolase or bile salt transporter producing cassettes.

In certain embodiments, the genetically engineered bacteria comprise one or more gene cassettes as described herein, which modulate typtophan levels in the patient, e.g., in the serum and/or in the gut. In certain embodiments, the genetically engineered bacteria comprise one or more gene cassettes as described herein, which modulate kynurenine levels in the patient, e.g., in the serum and/or in the gut. In certain embodiments, the genetically engineered bacteria comprise one or more gene cassettes as described herein, which modulate levels of downstream kynurenine metabolites described herein in the patient, e.g., in the serum and/or in the gut. In certain embodiments, the genetically engineered bacteria comprise one or more gene cassettes as described herein, which modulate levels of downstream tryptophan metabolites described herein, including, but not limited to those listed in Table 13 and FIG. 32 and elsewhere herein, in the patient, e.g., in the serum and/or in the gut.

In certain embodiments, the genetically engineered bacteria comprise one or more gene cassettes as described herein, which modulate the TRP/KYN ratio in the patient, e.g., in the serum and/or in the gut. In some embodiments, the genetically engineered bacteria comprise gene cassettes which modulate the ratios of tryptophan to one or more tryptophan metabolites, including, but not limited to those listed in Table 13 and FIG. 32 and elsewhere herein. In some embodiments, the genetically engineered bacteria comprise gene cassettes which modulate the ratios of tryptophan to one or more kynurenine downstream metabolites described herein, e.g., in FIG. 29. In some embodiments, the genetically engineered bacteria comprise gene cassettes which modulate the ratios of kynurenine to one or more tryptophan metabolites, including, but not limited to those listed in Table 13 and FIG. 32 and elsewhere herein. In some embodiments, the genetically engineered bacteria comprise gene cassettes which modulate the ratios of kynurenine to one or more downstream kynurenine metabolites, including, but not limited to those listed in Table 13 and FIG. 32 and elsewhere herein. In some embodiments, the genetically engineered bacteria comprise gene cassettes which modulate the ratios between two downstream kynurenine metabolites, including, but not limited to those listed in Table 13 and FIG. 32 and elsewhere herein. In some embodiments, the genetically engineered bacteria comprise gene cassettes which modulate the ratios between one or more tryptophan metabolites, including, but not limited to those listed in Table 13 and FIG. 32 and elsewhere herein.

In certain embodiments, the genetically engineered bacteria comprise one or more gene cassettes as described herein, which increase typtophan levels in the patient, e.g., in the serum and/or in the gut. In certain embodiments, the genetically engineered bacteria comprise one or more gene cassettes as described herein, which increase kynurenine levels in the patient, e.g., in the serum and/or in the gut. In certain embodiments, the genetically engineered bacteria comprise one or more gene cassettes as described herein, which increase levels of downstream kynurenine metabolites described herein in the patient, e.g., in the serum and/or in the gut. In certain embodiments, the genetically engineered bacteria comprise one or more gene cassettes as described herein, which increase levels of downstream tryptophan metabolites described herein, including, but not limited to those listed in Table 13 and FIG. 32 and elsewhere herein, in the patient, e.g., in the serum and/or in the gut.

In certain embodiments, the genetically engineered bacteria comprise one or more gene cassettes as described herein, which increase the TRP/KYN ratio in the patient, e.g., in the serum and/or in the gut. In some embodiments, the genetically engineered bacteria comprise gene cassettes which increase the ratios of tryptophan to one or more tryptophan metabolites, including, but not limited to those listed in Table 13 and FIG. 32 and elsewhere herein. In some embodiments, the genetically engineered bacteria comprise gene cassettes which increase the ratios of tryptophan to one or more kynurenine downstream metabolites described herein, e.g., in FIG. 29. In some embodiments, the genetically engineered bacteria comprise gene cassettes which increase the ratios of kynurenine to one or more tryptophan metabolites, including, but not limited to those listed in Table 13 and FIG. 32 and elsewhere herein. In some embodiments, the genetically engineered bacteria comprise gene cassettes which increase the ratios of kynurenine to one or more downstream kynurenine metabolites, including, but not limited to those listed in Table 13 and FIG. 32 and elsewhere herein. In some embodiments, the genetically engineered bacteria comprise gene cassettes which increase the ratios between two downstream kynurenine metabolites, including, but not limited to those listed in Table 13 and FIG. 32 and elsewhere herein. In some embodiments, the genetically engineered bacteria comprise gene cassettes which increase the ratios between one or more tryptophan metabolites, including, but not limited to those listed in Table 13 and FIG. 32 and elsewhere herein.

In certain embodiments, the genetically engineered bacteria comprise one or more gene cassettes as described herein, which decrease typtophan levels in the patient, e.g., in the serum and/or in the gut. In certain embodiments, the genetically engineered bacteria comprise one or more gene cassettes as described herein, which decrease kynurenine levels in the patient, e.g., in the serum and/or in the gut. In certain embodiments, the genetically engineered bacteria comprise one or more gene cassettes as described herein, which decrease levels of downstream kynurenine metabolites described herein in the patient, e.g., in the serum and/or in the gut. In certain embodiments, the genetically engineered bacteria comprise one or more gene cassettes as described herein, which decrease levels of downstream tryptophan metabolites described herein, including, but not limited to those listed in Table 13 and FIG. 32 and elsewhere herein, in the patient, e.g., in the serum and/or in the gut.

In certain embodiments, the genetically engineered bacteria comprise one or more gene cassettes as described herein, which decrease the TRP/KYN ratio in the patient, e.g., in the serum and/or in the gut. In some embodiments, the genetically engineered bacteria comprise gene cassettes which decrease the ratios of tryptophan to one or more tryptophan metabolites, including, but not limited to those listed in Table 13 and FIG. 32 and elsewhere herein. In some embodiments, the genetically engineered bacteria comprise gene cassettes which decrease the ratios of tryptophan to one or more kynurenine downstream metabolites described herein, e.g., in FIG. 29. In some embodiments, the genetically engineered bacteria comprise gene cassettes which decrease the ratios of kynurenine to one or more tryptophan metabolites, including, but not limited to those listed in Table 13 and FIG. 32 and elsewhere herein. In some embodiments, the genetically engineered bacteria comprise gene cassettes which decrease the ratios of kynurenine to one or more downstream kynurenine metabolites, including, but not limited to those listed in Table 13 and FIG. 32 and elsewhere herein. In some embodiments, the genetically engineered bacteria comprise gene cassettes which decrease the ratios between two downstream kynurenine metabolites, including, but not limited to those listed in Table 13 and FIG. 32 and elsewhere herein. In some embodiments, the genetically engineered bacteria comprise gene cassettes which decrease the ratios between one or more tryptophan metabolites, including, but not limited to those listed in Table 13 and FIG. 32 and elsewhere herein.

In some embodiments, the genetically engineered bacteria comprise a gene cassette which modulates serotonin and or melatonin levels. In some embodiments, the genetically engineered bacteria comprise a gene cassette which increases serotonin and or melatonin levels. In some embodiments, the genetically engineered bacteria comprise a gene cassette which decreases serotonin and or melatonin levels. In some embodiments, the genetically engineered bacteria comprise a gene cassette which modulates the tryptophan to serotonin and or melatonin ratios. In some embodiments, the genetically engineered bacteria comprise a gene cassette which increases the tryptophan to serotonin and or melatonin ratios. In some embodiments, the genetically engineered bacteria comprise a gene cassette which decreases the tryptophan to serotonin and or melatonin ratios.

In certain embodiments, one or more of these circuits may be combined for the treatment of cardionvascular disorders. In a non-limiting example, butyrate producing, GLP-1 secreting, and ryptophan pathway modulating cassettes may be expressed in combination by the genetically engineered bacteria for the treatment of cardionvascular disorders.

Metabolic and Satiety Effector Molecules, and Modulators of Inflammation

The genetically engineered bacteria of the invention comprise a gene encoding a non-native metabolic and/or satiety effector molecule, or a gene cassette encoding a biosynthetic pathway capable of producing a metabolic and/or satiety effector molecule. In some embodiments, the metabolic and/or satiety effector molecule is selected from the group consisting of n-acyl-phophatidylethanolamines (NAPEs), n-acyl-ethanolamines (NAEs), ghrelin receptor antagonists, peptide YY3-36, cholecystokinin (CCK) family molecules, CCK58, CCK33, CCK22, CCK8, bombesin family molecules, bombesin, gastrin releasing peptide (GRP), neuromedin B (P), glucagon, GLP-1, GLP-2, apolipoprotein A-IV, amylin, somatostatin, enterostatin, oxyntomodulin, pancreatic peptide, short-chain fatty acids, butyrate, propionate, acetate, serotonin receptor agonists, nicotinamide adenine dinucleotide (NAD), nicotinamide mononucleotide (NMN), nucleotide riboside (NR), nicotinamide, and nicotinic acid (NA). A molecule may be primarily a metabolic effector, or primarily a satiety effector. Alternatively, a molecule may be both a metabolic and satiety effector.

In some embodiments, the genetically engineered bacteria of the invention comprise one or more gene(s) or gene cassette(s) which are capable of producing an effector, which can modulate the inflammatory status. Non-limiting examples include short shain fatty acids, and tryptophan and its metabolites, as described herein.

The effect of the genetically engineered bacteria on the inflammatory status can be measured by methods known in the art, e.g., plasma can be drawn before and after administration of the genetically engineered bacteria. The erythrocyte sedimentation rate (ESR), C-reactive protein (CRP) and plasma viscosity (PV) blood tests are commonly used to detect this increase n inflammation. In some embodiments the genetically engineered bacteria modulate, e.g. decrease or increase, levels of inflammatory markers, eg. C-reactive protein (CRP).

In some embodiments, the genetically engineered bacteria modulate, e.g. decrease, levels of inflammatory growth factors and cytokines, e.g., IL-1β, IL-6, and/or TNF-α and proinflammatory signaling, e.g. NF-kappaB signaling. In some embodiments the genetically engineered bacteria modulate, e.g. increase, levels of anti-inflammatory growth factors and cytokines, e.g., IL4, IL-10, IL-13, IFN-alpha and/or transforming growth factor-beta. [0210]

In some embodiments, the genetically engineered bacteria produce effectors, which bind to and stimulate the aromatic hydrocarbon receptor. In some embodiments the genetically engineered bacteria stimulate AHR signaling in immune cell types, including T cells, B cells, NK cells, macrophages, and dendritic cells (DCs), and/or in epithelial cells. In some embodiments, the genetically engineered bacteria modulate, e.g., increase the levels of IL-22, e.g., through stimulation of AHR.

In some embodiments, the genetically engineered bacteria may reduce gut permeability. In some embodiments, the genetically engineered bacteria may reduce the amounts of LPS and in the circulation, which are increase in metabolic disease, e.g., in NASH.

The gene or gene cassette for producing the metabolic and/or satiety effector molecule and/or modulator of inflammation may be expressed under the control of a constitutive promoter, a promoter that is induced by exogenous environmental conditions, a promoter that is induced by exogenous environmental conditions, molecules, or metabolites specific to the gut of a mammal, and/or a promoter that is induced by low-oxygen or anaerobic conditions, such as the environment of the mammalian gut.

The gene or gene cassette for producing the metabolic and/or satiety effector and/or modulator of inflammation may be expressed on a high-copy plasmid, a low-copy plasmid, or a chromosome. In some embodiments, expression from the plasmid may be useful for increasing expression of the metabolic and/or satiety effector molecule. In some embodiments, expression from the chromosome may be useful for increasing stability of expression of the metabolic and/or satiety effector molecule. In some embodiments, the gene or gene cassette for producing the metabolic and/or satiety effector molecule is integrated into the bacterial chromosome at one or more integration sites in the genetically engineered bacteria. For example, one or more copies of the propionate biosynthesis gene cassette may be integrated into the bacterial chromosome. In some embodiments, the gene or gene cassette for producing the metabolic and/or satiety effector molecule is expressed from a plasmid in the genetically engineered bacteria. In some embodiments, the gene or gene cassette for producing the metabolic and/or satiety effector molecule is inserted into the bacterial genome at one or more of the following insertion sites in *E. coli* Nissle: malE/K, araC/BAD, lacZ, thyA, malP/T. Any suitable insertion site may be used (see, e.g. FIG. 47). The insertion site may be anywhere in the genome, e.g., in a gene required for survival and/or growth, such as thyA (to create an auxotroph); in an active area of the genome, such as near the site of genome replication; and/or in between divergent promoters in order to reduce the risk of unintended transcription, such as between AraB and AraC of the arabinose operon. In some embodiments, the genetically engineered bacteria of the invention are capable of expressing a metabolic and/or satiety effector molecule that is encoded by a single gene, e.g., the molecule is GLP-1 and encoded by the GLP-1 gene.

One of skill in the art would appreciate that additional genes and gene cassettes capable of producing metabolic and/or satiety effector molecules and/or modulator of inflammation are known in the art and may be expressed by the genetically engineered bacteria of the invention. In some embodiments, the gene or gene cassette for producing a therapeutic molecule also comprises additional transcription and translation elements, e.g., a ribosome binding site, to enhance expression of the therapeutic molecule.

In some embodiments, the genetically engineered bacteria produce two or more metabolic and/or satiety effector molecules and/or modulator of inflammation. In certain embodiments, the two or more molecules behave synergistically to ameliorate metabolic disease. In some embodiments, the genetically engineered bacteria express at least one metabolic effector molecule and at least one satiety effector molecule and at least one modulator of inflammation.

Short Chain Fatty Acids

Short-chain fatty acids (SCFAs), primarily acetate, propionate, and butyrate, are metabolites formed by gut microbiota from complex dietary carbohydrates. Butyrate and acetate were reported to protect against diet-induced obesity without causing hypophagia, while propionate was shown to reduce food intake. In rodent models of genetic or diet-induced obesity, supplementation of butyrate in diet, and oral administration of acetate was shown to suppress weight gain independent of food intake suppression; Propionate was reported to inhibit food intake in humans (see, e.g., Lin et al., Butyrate and Propionate Protect against Diet-Induced Obesity and Regulate Gut Hormones via Free Fatty Acid Receptor 3-Independent Mechanisms, and references therein). Therefore, the production of SCFAs is likely efficacious in the treatment of metabolic syndrome and related disorders, and/or diabetes type2, and/or obesity.

SCFAs represent a major constituent of the luminal contents of the colon. Among SCFAs butyrate is believed to play an important role for epithelial homeostasis. Acetate and propionate have anti-inflammatory properties, which are comparable to those of butyrate (Tedelind et al., World J Gastroenterol. 2007 May 28; 13(20): 2826-2832. Acetate and propionate, similar to butyrate, inhibit TNFα-mediated activation of the NF-κB pathway. These findings suggest that propionate and acetate, in addition to butyrate, could be efficacious in the treatment of inflammatory conditions.

Propionate

In alternate embodiments, the genetically engineered bacteria of the invention are capable of producing a metabolic and/or satiety effector molecule, e.g., propionate, that is synthesized by a biosynthetic pathway requiring multiple genes and/or enzymes.

In some embodiments, the genetically engineered bacteria of the invention comprise a propionate gene cassette and are capable of producing propionate under particular exogenous environmental conditions. The genetically engineered bacteria may express any suitable set of propionate biosynthesis genes (see, e.g., Table 2). Unmodified bacteria that are capable of producing propionate via an endogenous propionate biosynthesis pathway include, but are not limited to, *Clostridium propionicum, Megasphaera elsdenii*, and *Prevotella ruminicola*. In some embodiments, the genetically engineered bacteria of the invention comprise propionate biosynthesis genes from a different species, strain, or substrain of bacteria. In some embodiments, the genetically engineered bacteria comprise the genes pct, lcd, and acr from *Clostridium propionicum*. In some embodiments, the genetically engineered bacteria comprise acrylate pathway genes for propionate biosynthesis, e.g., pct, lcdA, lcdB, lcdC, etfA, acrB, and acrC. In some embodiments, the rate limiting step catalyzed by the Acr enzyme, is replaced by the Acul from *R. sphaeroides*, which catalyzes the NADPH-dependent acrylyl-CoA reduction to produce propionyl-CoA. Thus the propionate cassette comprises pct, lcdA, lcdB, lcdC, and acul. In another embodiment, the homolog of Acul in *E. coli*, yhdH is used. This propionate cassette comprises pct, lcdA, lcdB, lcdC, and yhdH. In alternate embodiments, the genetically engineered bacteria comprise pyruvate pathway genes for propionate biosynthesis, e.g., thrA$^{fbr}$, thrB, thrC, ilvA$^{fbr}$, aceE, aceF, and lpd, and optionally further comprise tesB. In another embodiment, the propionate gene cassette comprises the genes of the Sleeping Beauty Mutase operon, e.g., from *E. coli* (sbm, ygfD, ygfG, ygfH). The SBM pathway is cyclical and composed of a series of biochemical conversions forming propionate as a fermentative product while regenerating the starting molecule of succinyl-CoA. Sbm converts succinyl CoA to L-methylmalonylCoA, ygfG converts L-methylmalonyl-CoA into PropionylCoA, and ygfH converts propionylCoA into propionate and succinate into succinylCoA.

This pathway is very similar to the oxidative propionate pathway of Propionibacteria, which also converts succinate to propionate. Succinyl-CoA is converted to R-methylmalonyl-CoA by methymalonyl-CoA mutase (mutAB). This is in turn converted to S-methylmalonyl-CoA via methymalonyl-CoA epimerase (GI:18042134). There are three genes which encode methylmalonyl-CoA carboxytransferase (mmdA, PFREUD_18870, bccp) which converts methylmalonyl-CoA to propionyl-CoA.

The genes may be codon-optimized, and translational and transcriptional elements may be added. Table 2-4 lists the nucleic acid sequences of exemplary genes in the propionate biosynthesis gene cassette. Table 5 lists the polypeptide sequences expressed by exemplary propionate biosynthesis genes.

TABLE 2

Propionate Cassette Sequences (Acrylate Pathway)

| Gene sequence | Description |
| --- | --- |
| pct SEQ ID NO: 1 | ATGCGCAAAGTGCCGATTATCACGGCTGACGAGGCCGCAAAACTGAT CAAGGACGGCGACACCGTGACAACTAGCGGCTTTGTGGGTA ACGCGATCCCTGAGGCCCTTGACCGTCAGTCGAAAAGCGTTTC CTGGAAACGGGCGAACCGAAGAACATTACTTATGTATATTGCGG CAGTCAGGGCAATCGCGACGGTCGTGGCGCAGAACATTTCGCGC ATGAAGGCCTGCTGAAACGTTATATCGCTGGCCATTGGGCGACC GTCCCGGCGTTAGGGAAAATGGCCATGGAGAATAAAATGGAGGC CTACAATGTCTCTCAGGGCGCCTTGTGTCATCTCTTTCGCGATA TTGCGAGCCATAAACCGGGTGTGTTCACGAAAGTAGGAATCGGC ACCTTCATTGATCCACGTAACGGTGGTGGGAAGGTCAACGATAT TACCAAGGAAGATATCGTAGAACTGGTGGAAATTAAAGGGCAGG AATACCTGTTTTATCCGGCGTTCCCGATCCATGTCGCGCTGATT CGTGGCACCTATGCGGACGAGAGTGGTAACATCACCTTTGAAAA AGAGGTAGCGCCTTTGGAAGGGACTTCTGTCTGTCAAGCGGTGA AGAACTCGGGTGGCATTGTCGTGGTTCAGGTTGAGCGTGTCGTC AAAGCAGGCACGCTGGATCCGCGCCATGTGAAAGTTCCGGGTAT CTATGTAGATTACGTAGTCGTCGCGGATCCGGAGGACCATCAAC AGTCCCTTGACTGCGAATATGATCCTGCCCTTAGTGGAGAGCAC |

TABLE 2-continued

Propionate Cassette Sequences (Acrylate Pathway)

| Gene sequence | Description |
|---|---|
| | CGTCGTCCGGAGGTGGTGGGTGAACCACTGCCTTTATCCGCGAA<br>GAAAGTCATCGGCCGCCGTGGCGCGATTGAGCTCGAGAAAGACG<br>TTGCAGTGAACCTTGGGGTAGGTGCACCTGAGTATGTGGCCTCC<br>GTGGCCGATGAAGAAGGCATTGTGGATTTTATGACTCTCACAGC<br>GGAGTCCGGCGCTATCGGTGGCGTTCCAGCCGGCGGTGTTCGCT<br>TTGGGGCGAGCTACAATGCTGACGCCTTGATCGACCAGGGCTAC<br>CAATTTGATTATTACGACGGTGGGGGTCTGGATCTTTGTTACCT<br>GGGTTTAGCTGAATGCGACGAAAAGGGTAATATCAATGTTAGCC<br>GCTTCGGTCCTCGTATCGCTGGGTGCGGCGGATTCATTAACATT<br>ACCCAAAACACGCCGAAAGTCTTCTTTTGTGGGACCTTTACAGC<br>CGGGGGGCTGAAAGTGAAAATTGAAGATGGTAAGGTGATTATCG<br>TTCAGGAAGGGAAACAGAAGAAATTCCTTAAGGCAGTGGAGCAA<br>ATCACCTTTAATGGAGACGTGGCCTTAGCGAACAAGCAACAAGT<br>TACCTACATCACGGAGCGTTGCGTCTTCCTCCTCAAAGAAGACG<br>GTTTACACCTTTCGGAAATCGCGCCAGGCATCGATCTGCAGACC<br>CAGATTTTGGATGTTATGGACTTTGCCCCGATCATTGATCGTGA<br>CGCAAACGGGCAGATTAAACTGATGGACGCGGCGTTATTCGCAG<br>AAGGGCTGATGGGCTTGAAAGAAATGAAGTCTTAA |
| lcdA<br>SEQ ID NO: 2 | ATGAGCTTAACCCAAGGCATGAAAGCTAAACAACTGTTAGCATA<br>CTTTCAGGGTAAAGCCGATCAGGATGCACGTGAAGCGAAAGCCC<br>GCGGTGAGCTGGTCTGCTGGTCGGCGTCAGTCGCGCCGCCGGAA<br>TTTTGCGTAACAATGGGCATTGCCATGATCTACCCGGAGACTCA<br>TGCAGCGGGCATCGGTGCCCGCAAAGGTGCGATGGACATGCTGG<br>AAGTTGCGGACCGCAAAGGCTACAACGTGGATTGTTGTTCCTAC<br>GGCCGTGTAAATATGGGTTACATGGAATGTTTAAAAGAAGCCGC<br>CATCACGGGCGTCAAGCCGGAAGTTTTGGTTAATTCCCCTGCTG<br>CTGACGTTCCGCTTCCCGATTGGTGATTACGTGTAATAATATC<br>TGTAACACGCTGCTGAAATGGTACGAAAACTTAGCAGCAGAACT<br>CGATATTCCTTGCATCGTGATCGACGTACCGTTTAATCATACCA<br>TGCCGATTCCGGAATATGCCAAGGCCTACATCGCGGACCAGTTC<br>CGCAATGCAATTTCTCAGCTGGAAGTTATTTGTGGCCGTCCGTT<br>CGATTGGAAGAAATTTAAGGAGGTCAAAGATCAGACCCAGCGTA<br>GCGTATACCACTGGAACCGCATTGCCGAGATGGCGAAATACAAG<br>CCTAGCCCGCTGAACGGCTTCGATCTGTTCAATTACATGGCGTT<br>AATCGTGGCGTGCCGCAGCCTGGATTATGCAGAAATTACCTTTA<br>AAGCGTTCGCGGACGAATTAGAAGAGAATTTGAAGGCGGGTATC<br>TACGCCTTTAAAGGTGCGGAAAAAACGCGCTTTCAATGGGAAGG<br>TATCGCGGTGTGGCCACATTTAGGTCACACGTTTAAATCTATGA<br>AGAATCTGAATTCGATTATGACCGGTACGGCATACCCCGCCCTT<br>TGGGACCTGCACTATGACGCTAACGACGAATCTATGCACTCTAT<br>GGCTGAAGCGTACACCCGTATTTATATTAATACTTGTCTGCAGA<br>ACAAAGTAGAGGTCCTGCTTGGGATCATGGAAAAAGGCCAGGTG<br>GATGGTACCGTATATCATCTGAATCGCAGCTGCAAACTGATGAG<br>TTTCCTGAACGTGGAAACGGCTGAAATTATTAAAGAGAAGAACG<br>GTCTTCCTTACGTCTCCATTGATGGCGATCAGACCGATCCTCGC<br>GTTTTTTCTCCGGCCCAGTTTGATACCCGTGTTCAGGCCCTGGT<br>TGAGATGATGGAGGCCAATATGGCGGCAGCGGAATAA |
| lcdB<br>SEQ ID NO: 3 | ATGTCACGCGTGGAGGCAATCCTGTCGCAGCTGAAAGATGTCGC<br>CGCGAATCCGAAAAAAGCCATGGATGACTATAAAGCTGAAACAG<br>GTAAGGGCGCGGTTGGTATCATGCCGATCTACAGCCCCGAAGAA<br>ATGGTACACGCCGCTGGCTATTTGCCGATGGGAATCTGGGGCGC<br>CCAGGGCAAAACGATTAGTAAAGCGCGCACCTATCTGCCTGCTT<br>TTGCCTGCAGCGTAATGCAGCAGGTTATGGAATTACAGTGCGAG<br>GGCGCGTATGATGACCTGTCCGCAGTTATTTTTAGCGTACCGTG<br>CGACACTCTCAAATGTCTTAGCCAGAAATGGAAAGGTACGTCCC<br>CAGTGATTGTATTTACGCATCCGCAGAACCGCGGATTAGAAGCG<br>GCGAACCAATTCTTGGTTACCGAGTATGAACTGGTAAAAGCACA<br>ACTGGAATCAGTTCTGGGTGTGAAAATTTCAAACGCCGCCCTGG<br>AAAAATTCGATTGCAATTTATAACGAGAATCGTGCCGTGATGCGT<br>GAGTTCGTGAAAGTGGCAGCGGACTATCCTCAAGTCATTGACGC<br>AGTGAGCCGCCACGCGGTTTTTAAAGCGCGCCAGTTTATGCTTA<br>AGGAAAAACATACCGCACTTGTGAAAGAACTGATCGCTGAGATT<br>AAAGCAACGCCAGTCCAGCCGTGGGACGAAAAAGGTTGTAGT<br>GACGGGCATTCTGTTGGAACCGAATGAGTTATTAGATATCTTTA<br>ATGAGTTTAAGATCGCGATTGTTGATGATGATTTAGCGCAGGAA<br>AGCCGTCAGATCCGTGTTGACGTTCTGGACGGAGAAGGCGGACC<br>GCTCTACCGTATGGCTAAAGCGTGGCAGCAAATGTATGGCTGCT<br>CGCTGGCAACCGACACCAAGAAGGGTCGCGGCCGTATGTTAATT<br>AACAAAACGATTCAGACCGGTGCGGACGCTATCGTAGTTGCAAT<br>GATGAAGTTTTGCGACCCAGAAGAATGGGATTATCCGGTAATGT<br>ACCGTGAATTTGAAGAAAAGGGGTCAAATCACTTATGATTGAG<br>GTGGATCAGGAAGTATCGTCTTTCGAACAGATTAAAACCCGTCT<br>GCAGTCATTCGTCGAAATGCTTTAA |

TABLE 2-continued

Propionate Cassette Sequences (Acrylate Pathway)

| Gene sequence | Description |
|---|---|
| lcdC<br>SEQ ID NO: 4 | ATGTATACCTTGGGGATTGATGTCGGTTCTGCCTCTAGTAAAGC<br>GGTGATTCTGAAAGATGGAAAAGATATTGTCGCTGCCGAGGTTG<br>TCCAAGTCGGTACCGGCTCCTCGGGTCCCCAACGCGCACTGGAC<br>AAAGCCTTTGAAGTCTCTGGCTTAAAAAAGGAAGACATCAGCTA<br>CACAGTAGCTACGGGCTATGGGCGCTTCAATTTTAGCGACGCGG<br>ATAAACAGATTTCGGAAATTAGCTGTCATGCCAAAGGCATTTAT<br>TTCTTAGTACCAACTGCGCGCACTATTATTGACATTGGCGGCCA<br>AGATGCGAAAGCCATCCGCCTGGACGACAAGGGGGGTATTAAGC<br>AATTCTTCATGAATGATAAATGCGCGGCGGGCACGGGGCGTTTC<br>CTGGAAGTCATGGCTCGCGTACTTGAAACCACCCTGGATGAAAT<br>GGCTGAACTGGATGAACAGGCGACTGACACCGCTCCCATTTCAA<br>GCACCTGCACGGTTTTCGCCGAAAGCGAAGTAATTAGCCAATTG<br>AGCAATGGTGTCTCACGCAACAACATCATTAAAGGTGTCCATCT<br>GAGCGTTGCGTCACGTGCGTGTGGTCTGGCGTATCGCGGCGGTT<br>TGGAGAAAGATGTTGTTATGACAGGTGGCGTGGCAAAAAATGCA<br>GGGGTGGTGCGCGCGGTGGCGGGCGTTCTGAAGACCGATGTTAT<br>CGTTGCTCCGAATCCTCAGACGACCGGTGCACTGGGGGCAGCGC<br>TGTATGCTTATGAGGCCGCCCAGAAGAAGTA |
| etfA<br>SEQ ID NO: 5 | ATGGCCTTCAATAGCGCAGATATTAATTCTTTCCGCGATATTTG<br>GGTGTTTTGTGAACAGCGTGAGGGCAAACTGATTAACACCGATT<br>TCGAATTAATTAGCGAAGGTCGTAAACTGGCTGACGAACGCGGA<br>AGCAAACTGGTTGAATTTTGCTGGGGCACGAAGTTGAAGAAAT<br>CGCAAAAGAATTAGGCGGCTATGGTGCGGACAAGGTAATTGTGT<br>GCGATCATCCGGAACTTAAATTTTACACTACGGATGCTTATGCC<br>AAAGTTTTATGTGACGTCGTGATGGAAGAGAAACCGGAGGTAAT<br>TTTGATCGGTGCCACCAACATTGGCCGTGATCTCGGACCGCGTT<br>GTGCTGCACGCTTGCACACGGGGCTGACGGCTGATTGCACGCAC<br>CTGGATATTGATATGAATAAATATGTGGACTTTCTTAGCACCAG<br>TAGCACCTTGGATATCTCGTCGATGACTTTCCCTATGGAAGATA<br>CAAACCTTAAAATGACGCGCCCTGCATTTGGCGGACATCTGATG<br>GCAACGATCATTTGTCCACGCTTCCGTCCCTGTATGAGCACAGT<br>GCGCCCCGGAGTGATGAAGAAAGCGGAGTTCTCGCAGGAGATGG<br>CGCAAGCATGTCAAGTAGTGACCCGTCACGTAAATTTGTCGGAT<br>GAAGACCTTAAAACTAAAGTAATTAATATCGTGAAGGAAACGAA<br>AAAGATTGTGGATCTGATCGGCGCAGAAATTATTGTGTCAGTTG<br>GTCGTGGTATCTCGAAAGATGTCCAAGGTGGAATTGCACTGGCT<br>GAAAAACTTGCGGACGCATTTGGTAACGGTGTCGTGGGCGGCTC<br>GCGCGCAGTGATTGATTCCGGCTGGTTACCTGCGGATCATCAGG<br>TTGGACAAACCGGTAAGACCGTGCACCCGAAAGTCTACGTGGCG<br>CTGGGTATTAGTGGGGCTATCCAGCATAAGGCTGGGATGCAAGA<br>CTCTGAACTGATCATTGCCGTCAACAAAGACGAAACGGCGCCTA<br>TCTTCGACTGCGCCGATTATGGCATCACCGGTGATTTATTTAAA<br>ATCGTACCGATGATGATCGACGCGATCAAAGAGGGTAAAAACGC<br>ATGA |
| acrB<br>SEQ ID NO: 6 | ATGCGCATCTATGTGTGTGTGAAACAAGTCCCAGATACGAGCGG<br>CAAGGTGGCCGTTAACCCTGATGGGACCCTTAACCGTGCCTCAA<br>TGGCAGCGATTATTAACCCGGACGATATGTCCGCGATCGAACAG<br>GCATTAAAACTGAAAGATGAAACCGGATGCCAGGTTACGGCGCT<br>TACGATGGGTCCTCCTCCTGCCGAGGGCATGTTGCGCGAAATTA<br>TTGCAATGGGGGCCGACGATGGTGTGCTGATTTCGGCCCGTGAA<br>TTTGGGGGGTCCGATACCTTCGCAACCAGTCAAATTATTAGCGC<br>GGCAATCCATAAATTAGGCTTAAGCAATGAAGACATGATCTTTT<br>GCGGTCGTCAGGCCATTGACGGTGATACGGCCCAAGTCGGCCCT<br>CAAATTGCCGAAAAACTGAGCATCCCACAGGTAACCTATGGCGC<br>AGGAATCAAAAAATCTGGTGATTTAGTGCTGGTGAAGCGTATGT<br>TGGAGGATGGTTATATGATGATCGAAGTCGAAACTCCATGTCTG<br>ATTACCTGCATTCAGGATAAAGCGGTAAAACCACGTTACATGAC<br>TCTCAACGGTATTATGGAATGCTACTCCAAGCCGCTCCTCGTTC<br>TCGATTACGAAGCACTGAAAGATGAACCGCTGATCGAACTTGAT<br>ACCATTGGGCTTAAAGGCTCCCCGACGAATATCTTTAAATCGTT<br>TACGCCGCCTCAGAAAGGCGTTGGTGTCATGCTCCAAGGCACCG<br>ATAAGGAAAAAGTCGAGGATCTGGTGGATAAGCTGATGCAGAAA<br>CATGTCATCTAA |
| acrC<br>SEQ ID NO: 7 | ATGTTCTTACTGAAGATTAAAAAAGAACGTATGAAACGCATGGA<br>CTTTAGTTTAACGCGTGAACAGGAGATGTTAAAAAAACTGGCGC<br>GTCAGTTTGCTGAGATCGAGCTGGAACCGGTGGCCGAAGAGATT<br>GATCGTGAGCACGTTTTCCTGCAGAAAACTTTAAGAAGATGGC<br>GGAAATTGGCTTAACCGGCATTGGTATCCCGAAAGAATTTGGTG<br>GCTCCGGTGGAGGCACCCTGGAGAAGGTCATTGCCGTGTCAGAA<br>TTCGGCAAAAAGTGTATGGCCTCAGCTTCCATTTTAAGCATTCA<br>TCTTATCGCGCCGCAGGCAATCTACAAATATGGGACCAAAGAAC<br>AGAAAGAGACGTACCTGCCGCGTCTTACCAAAGGTGGTGAACTG<br>GGCGCCTTTGCGCTGACAGAACCAAACGCCGGAAGCGATGCCGG |

TABLE 2-continued

Propionate Cassette Sequences (Acrylate Pathway)

| Gene sequence | Description |
|---|---|
| | CGCGGTAAAAACGACCGCGATTCTGGACAGCCAGACAAACGAGT<br>ACGTGCTGAATGGCACCAAATGCTTTATCAGCGGGGGCGGGCGC<br>GCGGGTGTTCTTGTAATTTTTGCGCTTACTGAACCGAAAAAAGG<br>TCTGAAAGGGATGAGCGCGATTATCGTGGAGAAAGGGACCCCGG<br>GCTTCAGCATCGGCAAGGTGGAGAGCAAGATGGGGATCGCAGGT<br>TCGGAAACCGCGGAACTTATCTTCGAAGATTGTCGCGTTCCGGC<br>TGCCAACCTTTTAGGTAAAGAAGGCAAAGGCTTTAAAATTGCTA<br>TGGAAGCCCTGGATGGCGCCCGTATTGGCGTGGGCGCTCAAGCA<br>ATCGGAATTGCCGAGGGGGCGATCGACCTGAGTGTGAAGTACGT<br>TCACGAGCGCATTCAATTTGGTAAACCGATCGCGAATCTGCAGG<br>GAATTCAATGGTATATCGCGGATATGGCGACCAAAACCGCCGCG<br>GCACGCGCACTTGTTGAGTTTGCAGCGTATCTTGAAGACGCGGG<br>TAAACCGTTCACAAAGGAATCTGCTATGTGCAAGCTGAACGCCT<br>CCGAAAACGCGCGTTTTGTGACAAATTTAGCTCTGCAGATTCAC<br>GGGGGTTACGGTTATATGAAAGATTATCCGTTAGAGCGTATGTA<br>TCGCGATGCTAAGATTACGGAAATTTACGAGGGGACATCAGAAA<br>TCCATAAGGTGGTGATTGCGCGTGAAGTAATGAAACGCTAA |
| thrA<sup>fbr</sup><br>SEQ ID NO: 8 | ATGCGAGTGTTGAAGTTCGGCGGTACATCAGTGGCAAATGCAGA<br>ACGTTTTCTGCGTGTTGCCGATATTCTGGAAAGCAATGCCAGGC<br>AGGGGCAGGTGGCCACCGTCCTCTCTGCCCCCGCCAAAATCACC<br>AACCACCTGGTGGCGATGATTGAAAAAACCATTAGCGGCCAGGA<br>TGCTTTACCCAATATCAGCGATGCCGAACGTATTTTTGCCGAAC<br>TTTTGACGGGACTCGCCGCCGCCCAGCCGGGGTTCCCGCTGGCG<br>CAATTGAAAACTTTCGTCGATCAGGAATTTGCCCAAATAAAACA<br>TGTCCTGCATGGCATTAGTTTGTTGGGGCAGTGCCCGGATAGCA<br>TCAACGCTGCGCTGATTTGCCGTGGCGAGAAAATGTCGATCGCC<br>ATTATGGCCGGCGTATTAGAAGCGCGCGGTCACAACGTTACTGT<br>TATCGATCCGGTCGAAAAACTGCTGGCAGTGGGGCATTACCTCG<br>AATCTACCGTCGATATTGCTGAGTCCACCCGCCGTATTGCGGCA<br>AGCCGCATTCCGGCTGATCACATGGTGCTGATGGCAGGTTTCAC<br>CGCCGGTAATGAAAAAGGCGAACTGGTGGTGCTTGGACGCAACG<br>GTTCCGACTACTCTGCTGCGGTGCTGGCTGCCTGTTTACGCGCC<br>GATTGTTGCGAGATTTGGACGGACGTTGACGGGGTCTATACCTG<br>CGACCCGCGTCAGGTGCCCGATGCGAGGTTGTTGAAGTCGATGT<br>CCTACCAGGAAGCGATGGAGCTTTCCTACTTCGGCGCTAAAGTT<br>CTTCACCCCCGCACCATTACCCCCATCGCCCAGTTCCAGATCCC<br>TTGCCTGATTAAAAATACCGGAAATCCTCAAGCACCAGGTACGC<br>TCATTGGTGCCAGCCGTGATGAAGACGAATTACCGGTCAAGGGC<br>ATTTCCAATCTGAATAACATGGCAATGTTCAGCGTTTCTGGTCC<br>GGGGATGAAAGGGATGGTCGGCATGGCGGCGCGTCTTTGCAG<br>CGATGTCACGCGCCCGTATTTCCGTGGTGCTGATTACGCAATCA<br>TCTTCCGAATACAGCATCAGTTTCTGCGTTCCACAAAGCGACTG<br>TGTGCGAGCTGAACGGGCAATGCAGGAAGAGTTCTACCTGGAAC<br>TGAAAGAAGGCTTACTGGAGCCGCTGGCAGTGACGGAACGGCTG<br>GCCATTATCTCGGTGGTAGGTGATGGTATGCGCACCTTGCGTGG<br>GATCTCGGCGAAATTCTTTGCCGCACTGGCCCGCGCCAATATCA<br>ACATTGTCGCCATTGCTCAGAGATCTTCTGAACGCTCAATCTCT<br>GTCGTGGTAAATAACGATGATGCGACCACTGGCGTGCGCGTTAC<br>TCATCAGATGCTGTTCAATACCGATCAGGTTATCGAAGTGTTTG<br>TGATTGGCGTCGGTGGCGTTGGCGGTGCGCTGCTGGAGCAACTG<br>AAGCGTCAGCAAAGCTGGCTGAAGAATAAACATATCGACTTACG<br>TGTCTGCGGTGTTGCCAACTCGAAGGCTCTGCTCACCAATGTAC<br>ATGGCCTTAATCTGGAAAACTGGCAGGAAGAACTGGCGCAAGCC<br>AAAGAGCCGTTTAATCTCGGGCGCTTAATTCGCCTCGTGAAAGA<br>ATATCATCTGCTGAACCCGGTCATTGTTGACTGCACTTCCAGCC<br>AGGCAGTGGCGGATCAATATGCCGACTTCCTGCGCGAAGGTTTC<br>CACGTTGTCACGCCGAACAAAAAGGCCAACACCTCGTCGATGGA<br>TTACTACCATCAGTTGCGTTATGCGGCGAAAAATCGCGGCGTA<br>AATTCCTCTATGACACCAACGTTGGGCTGGATTACCGGTTATT<br>GAGAACCTGCAAAATCTGCTCAATGCAGGTGATGAATTGATGAA<br>GTTCTCCGGCATTCTTTCTGGTTCGCTTTCTTATATCTTCGGCA<br>AGTTAGACGAAGGCATGAGTTTCTCCGAGGCGACCACGCTGGCG<br>CGGGAAATGGGTTATACCGAACCGGACCCGCGAGATGATCTTTC<br>TGGTATGGATGTGGCGCGTAAACTATTGATTCTCGCTCGTGAAA<br>CGGGACGTGAACTGGAGCTGGCGGATATTGAAATTGAACCTGTG<br>CTGCCCGCAGAGTTTAACGCCGAGGGTGATGTTGCCGCTTTTAT<br>GGCGAATCTGTCACAACTCGACGATCTCTTTGCCGCGCGCGTGG<br>CGAAGGCCCGTGATGAAGGAAAAGTTTTGCGCTATGTTGGCAAT<br>ATTGATGAAGATGGCGTCTGCCGCGTGAAGATTGCCGAAGTGGA<br>TGGTAATGATCCGCTGTTCAAAGTGAAAAATGGCGAAAACGCCC<br>TGGCCTTCTATAGCCACTATTATCAGCCGCTGCCGTTGGTACTG<br>CGCGGATATGGTGCGGGCAATGACGTTACAGCTGCCGGTGTCTT<br>TGCTGATCTGCTACGTACCCTCTCATGGAAGTTAGGAGTCTGA |

TABLE 2-continued

Propionate Cassette Sequences (Acrylate Pathway)

| Gene sequence | Description |
|---|---|
| thrB<br>SEQ ID NO: 9 | ATGGTTAAAGTTTATGCCCCGGCTTCCAGTGCCAATATGAGCGT<br>CGGGTTTGATGTGCTCGGGGCGGCGGTGACACCTGTTGATGGTG<br>CATTGCTCGGAGATGTAGTCACGGTTGAGGCGGCAGAGACATTC<br>AGTCTCAACAACCTCGGACGCTTTGCCGATAAGCTGCCGTCAGA<br>ACCACGGGAAAATATCGTTTATCAGTGCTGGGAGCGTTTTTGCC<br>AGGAACTGGGTAAGCAAATTCCAGTGGCGATGACCCTGGAAAAG<br>AATATGCCGATCGGTTCGGGCTTAGGCTCCAGTGCCTGTTCGGT<br>GGTCGCGGCGCTGATGGCGATGAATGAACACTGCGGCAAGCCGC<br>TTAATGACACTCGTTTGCTGGCTTTGATGGGCGAGCTGGAAGGC<br>CGTATCTCCGGCAGCATTCATTACGACAACGTGGCACCGTGTTT<br>TCTCGGTGGTATGCAGTTGATGATCGAAGAAAACGACATCATCA<br>GCCAGCAAGTGCCAGGGTTTGATGAGTGGCTGTGGGTGCTGGCG<br>TATCCGGGGATTAAAGTCTCGACGGCAGAAGCCAGGGCTATTTT<br>ACCGGCGCAGTATCGCCGCCAGGATTGCATTGCGCACGGGCGAC<br>ATCTGGCAGGCTTCATTCACGCCTGCTATTCCCGTCAGCCTGAG<br>CTTGCCGCGAAGCTGATGAAAGATGTTATCGCTGAACCCTACCG<br>TGAACGGTTACTGCCAGGCTTCCGGCAGGCGCGGCAGGCGGTCG<br>CGGAAATCGGCGCGGTAGCGAGCGGTATCTCCGGCTCCGGCCCG<br>ACCTTGTTCGCTCTGTGTGACAAGCCGGAAACCGCCCAGCGCGT<br>TGCCGACTGGTTGGGTAAGAACTACCTGCAAAATCAGGAAGGTT<br>TTGTTCATATTTGCCGGCTGGATACGGCGGGCGCACGAGTACTG<br>GAAAACTAA |
| thrC<br>SEQ ID NO: 10 | ATGAAACTCTACAATCTGAAAGATCACAACGAGCAGGTCAGCTT<br>TGCGCAAGCCGTAACCCAGGGGTTGGGCAAAAATCAGGGGCTGT<br>TTTTTCCGCACGACCTGCCGGAATTCAGCCTGACTGAAATTGAT<br>GAGATGCTGAAGCTGGATTTTGTCACCCGCAGTGCGAAGATCCT<br>CTCGGCGTTTATTGGTGATGAAATCCCACAGGAAATCCTGGAAG<br>AGCGCGTGCGCGCGGCGTTTGCCTTCCCGGCTCCGGTCGCCAAT<br>GTTGAAAGCGATGTCGGTTGTCTGGAATTGTTCCACGGGCCAAC<br>GCTGGCATTTAAAGATTTCGGCGGTCGCTTTATGGCACAAATGC<br>TGACCCATATTGCGGGTGATAAGCCAGTGACCATTCTGACCGCG<br>ACCTCCGGTGATACCGGAGCGGCAGTGGCTCATGCTTTCTACGG<br>TTTACCGAATGTGAAAGTGGTTATCCTCTATCCACGAGGCAAAA<br>TCAGTCCACTGCAAGAAAAACTGTTCTGTACATTGGGCGGCAAT<br>ATCGAAACTGTTGCCATCGACGGCGATTTCGATGCCTGTCAGGC<br>GCTGGTGAAGCAGGCGTTTGATGATGAAGAACTGAAAGTGGCGC<br>TAGGGTTAAACTCGGCTAACTCGATTAACATCAGCGTTTGCTG<br>GCGCAGATTTGCTACTACTTTGAAGCTGTTGCGCAGCTGCCGCA<br>GGGAGACGCGCAACCAGCTGGTTGTCTCGGTGCCAAGCGGAAACT<br>TCGGCGATTTGACGGCGGGTCTGCTGGCGAAGTCACTCGGTCTG<br>CCGGTGAAACGTTTTATTGCTGCGACCAACGTGAACGATACCGT<br>GCCACGTTTCCTGCACGACGGTCAGTGGTCACCCAAAGCGACTC<br>AGGCGACGTTATCCAACGCGATGGACGTGAGTCAGCCGAACAAC<br>TGGCCGCGTGTGGAAGAGTTGTTCCGCCGCAAAATCTGGCAACT<br>GAAAGAGCTGGGTTATGCAGCCGTGGATGATGAAACCACGCAAC<br>AGACAATGCGTGAGTTAAAAGAACTGGGCTACACTTCGGAGCCG<br>CACGCTGCCGTAGCTTATCGTGCGCTGCGTGATCAGTTGAATCC<br>AGGCGAATATGGCTTGTTCCTCGGCACCGCGCATCCGGCGAAAT<br>TTAAAGAGAGCGTGGAAGCGATTCTCGGTGAAACGTTGGATCTG<br>CCAAAAGAGCTGGCAGAACGTGCTGATTTACCCTTGCTTTCACA<br>TAATCTGCCCGCCGATTTTGCTGCGTTGCGTAAATTGATGATGA<br>ATCATCAGTAA |
| ilvA<sup>fbr</sup><br>SEQ ID NO: 11 | ATGAGTGAAACATACGTGTCTGAGAAAAGTCCAGGAGTGATGGC<br>TAGCGGAGCGGAGCTGATTCGTGCCGCCGACATTCAAACGGCGC<br>AGGCACGAATTTCCTCCGTCATTGCACCAACTCCATTGCAGTAT<br>TGCCCTCGTCTTTCTGAGGAAACCGGAGCGGAAATCTACCTTAA<br>GCGTGAGGATCTGCAGGATGTTCGTTCCTACAAGATCCGCGGTG<br>CGCTGAACTCTGGAGCGCAGCTCACCCAAGAGCAGCGCGATGCA<br>GGTATCGTTGCCGCATCTGCAGGTAACCATGCCCAGGGCGTGGC<br>CTATGTGTGCAAGTCCTTGGGCGTTCAGGGACGCATCTATGTTC<br>CTGTGCAGACTCCAAAGCAAAAGCGTGACCGCATCATGGTTCAC<br>GGCGGAGAGTTTGTCTCCTTGGTGGTCACTGGCAATAACTTCGA<br>CGAAGCATCGGCTGCAGCGCATGAAGATGCAGAGCGCACCGGCG<br>CAACGCTGATCGAGCCTTTCGATGCTCGCAACACCGTCATCGGT<br>CAGGGCACCGTGGCTGCTGAGATCTTGTCGCAGCTGACTTCCAT<br>GGGCAAGAGTGCAGATCACGTGATGGTTCCAGTCGGCGGTGGCG<br>GACTTCTTGCAGGTGTGGTCAGCTACATGGCTGATATGGCACCT<br>CGCACTGCGATCGTTGGTATCGAACCAGCGGGAGCAGCATCCAT<br>GCAGGCTGCATTGCACAATGGTGGACCAATCACTTTGGAGACTG<br>TTGATCCCTTTGTGGACGGCGCAGCAGTCAAACGTGTCGGAGAT<br>CTCAACTACACCATCGTGGAGAAGAACCAGGGTCGCGTGCACAT<br>GATGAGCGCGACCGAGGGCGCTGTGTGTACTGAGATGCTCGATC<br>TTTACCAAAACGAAGGCATCATCGCGGAGCCTGCTGGCGCGCTG<br>TCTATCGCTGGGTTGAAGGAAATGTCCTTTGCACCTGGTTCTGC |

TABLE 2-continued

Propionate Cassette Sequences (Acrylate Pathway)

| Gene | sequence Description |
|---|---|
| | AGTGGTGTGCATCATCTCTGGTGGCAACAACGATGTGCTGCGTT |
| | ATGCGGAAATCGCTGAGCGCTCCTTGGTGCACCGCGGTTTGAAG |
| | CACTACTTCTTGGTGAACTTCCCGCAAAAGCCTGGTCAGTTGCG |
| | TCACTTCCTGGAAGATATCCTGGGACCGGATGATGACATCACGC |
| | TGTTTGAGTACCTCAAGCGCAACAACCGTGAGACCGGTACTGCG |
| | TTGGTGGGTATTCACTTGAGTGAAGCATCAGGATTGGATTCTTT |
| | GCTGGAACGTATGGAGGAATCGGCAATTGATTCCCGTCGCCTCG |
| | AGCCGGGCACCCCTGAGTACGAATACTTGACCTAA |
| aceE<br>SEQ ID NO: 12 | ATGTCAGAACGTTTCCCAAATGACGTGGATCCGATCGAAACTCG<br>CGACTGGCTCCAGGCGATCGAATCGGTCATCCGTGAAGAAGGTG<br>TTGAGCGTGCTCAGTATCTGATCGACCAACTGCTTGCTGAAGCC<br>CGCAAAGGCGGTGTAAACGTAGCCGCAGGCACAGGTATCAGCAA<br>CTACATCAACACCATCCCCGTTGAAGAACAACCGGAGTATCCGG<br>GTAATCTGGAACTGGAACGCCGTATTCGTTCAGCTATCCGCTGG<br>AACGCCATCATGACGGTGCTGCGTGCGTCGAAAAAAGACCTCGA<br>ACTGGGCGGCCATATGGCGTCCTTCCAGTCTTCCGCAACCATTT<br>ATGATGTGTGCTTTAACCACTTCTTCCGTGCACGCAACGAGCAG<br>GATGGCGGCGACCTGGTTTACTTCCAGGGCACATCTCCCCGGG<br>CGTGTACGCTCGTGCTTTCCTGGAAGGTCGTCTGACTCAGGAGC<br>AGCTGGATAACTTCCGTCAGGAAGTTCACGGCAATGGCCTCTCT<br>TCCTATCCGCACCCGAAACTGATGCCGGAATTCTGGCAGTTCCC<br>GACCGTATCTATGGGTCTGGGTCCGATTGGTGCTATTTACCAGG<br>CTAAATTCCTGAAATATCTGGAACACCGTGGCCTGAAAGATACC<br>TCTAAACAAACCGTTTACGCGTTCCTCGGTGACGGTGAAATGGA<br>CGAACCGGAATCCAAAGGTGCGATCACCATCGCTACCCGTGAAA<br>AACTGGATAACCTGGTCTTCGTTATCAACTGTAACCTGCAGCGT<br>CTTGACGGCCCGGTCACCGGTAACGGCAAGATCATCAACGAACT<br>GGAAGGCATCTTCGAAGGTGCTGGCTGGAACGTGATCAAAGTGA<br>TGTGGGGTAGCCGTTGGGATGAACTGCTGCGTAAGGATACCAGC<br>GGTAAACTGATCCAGCTGATGAACGAAACCGTTGACGGCGACTA<br>CCAGACCTTCAAATCGAAAGATGGTGCGTACGTTCGTAACACT<br>TCTTCGGTAAATATCCTGAAACCGCAGCACTGGTTGCAGACTGG<br>ACTGACGAGCAGATCTGGGCACTGAACCGTGGTGGTCACGATCC<br>GAAGAAAATCTACGCTGCATTCAAGAAAGCGCAGGAAACCAAAG<br>GCAAAGCGACAGTAATCCTTGCTCATACCATTAAAGGTTACGGC<br>ATGGGCGACGCGGCTGAAGGTAAAAACATCGCGCACCAGGTTAA<br>GAAAATGAACATGGACGGTGTGCGTCATATCCGCGACCGTTTCA<br>ATGTGCCGGTGTCTGATGCAGATATCGAAAAACTGCCGTACATC<br>ACCTTCCCGGAAGGTTCTGAAGAGCATACCTATCTGCACGCTCA<br>GCGTCAGAAACTGCACGGTTATCTGCCAAGCCGTCAGCCGAACT<br>TCACCGAGAAGCTTGAGCTGCCGAGCCTGCAAGACTTCGGCGCG<br>CTGTTGGAAGAGCAGAGCAAAGAGATCTCTACCACTATCGCTTT<br>CGTTCGTGCTCTGAACGTGATGCTGAAGAACAAGTCGATCAAAG<br>ATCGTCTGGTACCGATCATCGCCGACGAAGCGCGTACTTTCGGT<br>ATGGAAGGTCTGTTCCGTCAGATTGGTATTTACAGCCCGAACGG<br>TCAGCAGTACACCCCGCAGGACCGCGAGCAGGTTGCTTACTATA<br>AGAAGACGAGAAAGGTCAGATTCTGCAGGAAGGGATCAACGAG<br>CTGGGCGCAGGTTGTTCCTGGCTGGCAGCGGCGACCTCTTACAG<br>CACCAACAATCTGCCGATGATCCCGTTCTACATCTATTACTCGA<br>TGTTCGGCTTCCAGCGTATTGGCGATCTGTGCTGGGCGGCTGGC<br>GACCAGCAAGCGCGTGGCTTCCTGATCGGCGGTACTTCCGGTCG<br>TACCACCCTGAACGGCGAAGGTCTGCAGCACGAAGATGGTCACA<br>GCCACATTCAGTCGCTGACTATCCCGAACTGTATCTCTTACGAC<br>CCGGCTTACGCTTACGAAGTTGCTGTCATCATGCATGACGGTCT<br>GGAGCGTATGTACGGTGAAAAACAAGAGAACGTTTACTACTACA<br>TCACTACGCTGAACGAAAACTACCACATGCCGGCAATGCCGGAA<br>GGTGCTGAGGAAGGTATCCGTAAAGGTATCTACAAACTCGAAAC<br>TATTGAAGGTAGCAAAGGTAAAGTTCAGCTGCTCGGCTCCGGTT<br>CTATCCTGCGTCACGTCCGTGAAGCAGCTGAGATCCTGGCGAAA<br>GATTACGGCGTAGGTTCTGACGTTTATAGCGTGACCTCCTTCAC<br>CGAGCTGGCGCGTGATGGTCAGGATTGTGAACGCTGGAACATGC<br>TGCACCCGCTGGAAACTCCGCGCGTTCCGTATATCGCTCAGGTG<br>ATGAACGACGCTCCGGCAGTGGCATCTACCGACTATATGAAACT<br>GTTCGCTGAGCAGGTCCGTACTTACGTACCGGCTGACGACTACC<br>GCGTACTGGGTACTGATGCTTCGGTCGTTCCGACAGCCGTGAG<br>AACCTGCGTCACCACTTCGAAGTTGATGCTTCTTATGTCGTGGT<br>TGCGGCGCTGGGCGAACTGGCTAAACGTGGCGAAATCGATAAGA<br>AGTGGTTGCTGACGCAATCGCCAAATTCAACATCGATGCAGAT<br>AAAGTTAACCCGCGTCTGGCGTAA |
| aceF<br>SEQ ID NO: 13 | ATGGCTATCGAAATCAAAGTACCGGACATCGGGGCTGATGAAGT<br>TGAAATCACCGAGATCCTGGTCAAAGTGGGCGACAAAGTTGAAG<br>CCGAACAGTCGCTGATCACCGTAGAAGGCGACAAAGCCTCTATG<br>GAAGTTCCGTCTCCGCAGGCGGGTATCGTTAAAGAGATCAAAGT<br>CTCTGTTGGCGATAAAACCCAGACCGGCGCACTGATTATGATTT |

TABLE 2-continued

Propionate Cassette Sequences (Acrylate Pathway)

| Gene sequence | Description |
|---|---|
| | TCGATTCCGCCGACGGTGCAGCAGACGCTGCACCTGCTCAGGCA<br>GAAGAGAAGAAAGAAGCAGCTCCGGCAGCAGCACCAGCGGCTGC<br>GGCGGCAAAAGACGTTAACGTTCCGGATATCGGCAGCGACGAAG<br>TTGAAGTGACCGAAATCCTGGTGAAAGTTGGCGATAAAGTTGAA<br>GCTGAACAGTCGCTGATCACCGTAGAAGGCGACAAGGCTTCTAT<br>GGAAGTTCCGGCTCCGTTTGCTGGCACCGTGAAAGAGATCAAAG<br>TGAACGTGGGTGACAAAGTGTCTACCGGCTCGCTGATTATGGTC<br>TTCGAAGTCGCGGGTGAAGCAGGCGCGGCAGCTCCGGCCGCTAA<br>ACAGGAAGCAGCTCCGGCAGCGGCCCCTGCACCAGCGGCTGGCG<br>TGAAAGAAGTTAACGTTCCGGATATCGGCGGTGACGAAGTTGAA<br>GTGACTGAAGTGATGGTGAAAGTGGGCGACAAAGTTGCCGCTGA<br>ACAGTCACTGATCACCGTAGAAGGCGACAAAGCTTCTATGGAAG<br>TTCCGGCGCCGTTTGCAGGCGTCGTGAAGGAACTGAAAGTCAAC<br>GTTGGCGATAAAGTGAAAACTGGCTCGCTGATTATGATCTTCGA<br>AGTTGAAGGCGCAGCGCCTGCGGCAGCTCCTGCGAAACAGGAAG<br>CGGCAGCGCCGGCACCGGCAGCAAAAGCTGAAGCCCCGGCAGCA<br>GCACCAGCTGCGAAAGCGGAAGGCAAATCTGAATTTGCTGAAAA<br>CGACGCTTATGTTCACGCGACTCCGCTGATCCGCCGTCTGGCAC<br>GCGAGTTTGGTGTTAACCTTGCGAAAGTGAAGGGCACTGGCCGT<br>AAAGGTCGTATCCTGCGCGAAGACGTTCAGGCTTACGTGAAAGA<br>AGCTATCAAACGTGCAGAAGCAGCTCCGGCAGCGACTGGCGGTG<br>GTATCCCTGGCATGCTGCCGTGGCCGAAGGTGGACTTCAGCAAG<br>TTTGGTGAAATCGAAGAAGTGGAACTGGGCCGCATCCAGAAAAT<br>CTCTGGTGCGAACCTGAGCCGTAACTGGGTAATGATCCCGCATG<br>TTACTCACTTCGACAAAACCGATATCACCGAGTTGGAAGCGTTC<br>CGTAAACAGCAGAACGAAGAAGCGGCGAAACGTAAGCTGGATGT<br>GAAGATCACCCCGGTTGTCTTCATCATGAAAGCCGTTGCTGCAG<br>CTCTTGAGCAGATGCCTCGCTTCAATAGTTCGCTGTCGGAAGAC<br>GGTCAGCGTCTGACCCTGAAGAAATACATCAACATCGGTGTGGC<br>GGTGGATACCCCGAACGGTCTGGTTGTTCCGGTATTCAAAGACG<br>TCAACAAGAAAGGCATCATCGAGCTGTCTCGCGAGCTGATGACT<br>ATTTCTAAGAAAGCGCGTGACGGTAAGCTGACTGCGGGCGAAAT<br>GCAGGGCGGTTGCTTCACCATCTCCAGCATCGGCGGCCTGGGTA<br>CTACCCACTTCGCGCCGATTGTGAACGCGCCGGAAGTGGCTATC<br>CTCGGCGTTTCCAAGTCCGCGATGGAGCCGGTGTGGAATGGTAA<br>AGAGTTCGTGCCGCGTCTGATGCTGCCGATTTCTCTCTCCTTCG<br>ACCACCGCGTGATCGACGGTGCTGATGGTGCCCGTTTCATTACC<br>ATCATTAACAACACGCTGTCTGACATTCGCCGTCTGGTGATGTA<br>A |
| lpd<br>SEQ ID NO: 14 | ATGAGTACTGAAATCAAAACTCAGGTCGTGGTACTTGGGGCAGG<br>CCCCGCAGGTTACTCCGCTGCCTTCCGTTGCGCTGATTTAGGTC<br>TGGAAACCGTAATCGTAGAACGTTACAACACCCTTGGCGGTGTT<br>TGCCTGAACGTCGGCTGTATCCCTTCTAAAGCACTGCTGCACGT<br>AGCAAAAGTTATCGAAGAAGCCAAAGCGCTGGCTGAACACGGTA<br>TCGTCTTCGGCGAACCGAAAACCGATATCGACAAGATTCGTACC<br>TGGAAAGAGAAAGTGATCAATCAGCTGACCGGTGGTCTGGCTGG<br>TATGGCGAAAGGCCGCAAAGTCAAAGTGGTCAACGGTCTGGGTA<br>AATTCACCGGGGCTAACACCCTGGAAGTTGAAGGTGAGAACGGC<br>AAAACCGTGATCAACTTCGACAACGCGATCATTGCAGCGGGTTC<br>TCGCCCGATCCAACTGCCGTTTATTCCGCATGAAGATCCGCGTA<br>TCTGGGACTCCACTGACGCGCTGGAACTGAAAGAAGTACCAGAA<br>CGCCTGCTGGTAATGGGTGGCGGTATCATCGGTCTGGAAATGGG<br>CACCGTTTACCACGCGCTGGGTTCACAGATTGACGTGGTTGAAA<br>TGTTCGACCAGGTTATCCCGGCAGCTGACAAAGACATCGTTAAA<br>GTCTTCACCAAGCGTATCAGCAAGAAATTCAACCTGATGCTGGA<br>AACCAAAGTTACCGCCGTTGAAGCGAAAGAAGACGGCATTTATG<br>TGACGATGGAAGGCAAAAAAGCACCCGCTGAACCGCAGCGTTAC<br>GACGCCGTGCTGGTAGCGATTGGTCGTGTGCCGAACGGTAAAAA<br>CCTCGACGCAGGCAAAGCAGGCGTGGAAGTTGACGACCGTGGTT<br>TCATCCGCGTTGACAAACAGCTGCGTACCAACGTACCGCACATC<br>TTTGCTATCGGCGATATCGTCGGTCAACCGATGCTGGCACACAA<br>AGGTGTTCACGAAGGTCACGTTGCCGCTGAAGTTATCGCCGGTA<br>AGAAACACTACTTCGATCCGAAAGTTATCCCGTCCATCGCCTAT<br>ACCAAACCAGAAGTTGCATGGGTGGGTCTGACTGAGAAAGAAGC<br>GAAAGAGAAAGGCATCAGCTATGAAACCGCCACCTTCCCGTGGG<br>CTGCTTCTGGTCGTGCTATCGCTTCCGACTGCGCAGACGGTATG<br>ACCAAGCTGATTTTCGACAAAGAATCTCACCGTGTGATCGGTGG<br>TGCGATTGTCGGTACTAACGGCGGCGAGCTGCTGGGTGAAATCG<br>GCCTGGCAATCGAAATGGGTTGTGATGCTGAAGACATCGCACTG<br>ACCATCCACGCGCACCCGACTCTGCACGAGTCTGTGGGCCTGGC<br>GGCAGAAGTGTTCGAAGGTAGCATTACCGACCTGCCGAACCCGA<br>AAGCGAAGAAGAAGTAA |

TABLE 2-continued

Propionate Cassette Sequences (Acrylate Pathway)

| Gene sequence | Description |
|---|---|
| tesB<br>SEQ ID NO: 15 | ATGAGTCAGGCGCTAAAAAATTTACTGACATTGTTAAATCTGGA<br>AAAAATTGAGGAAGGACTCTTTCGCGGCCAGAGTGAAGATTTAG<br>GTTTACGCCAGGTGTTTGGCGGCCAGGTCGTGGGTCAGGCCTTG<br>TATGCTGCAAAAGAGACCGTCCCTGAAGAGCGGCTGGTACATTC<br>GTTTCACAGCTACTTTCTTCGCCCTGGCGATAGTAAGAAGCCGA<br>TTATTTATGATGTCGAAACGCTGCGTGACGGTAACAGCTTCAGC<br>GCCCGCCGGGTTGCTGCTATTCAAAACGGCAAACCGATTTTTTA<br>TATGACTGCCTCTTTCCAGGCACCAGAAGCGGGTTTCGAACATC<br>AAAAAACAATGCCGTCCGCGCCAGCGCCTGATGGCCTCCCTTCG<br>GAAACGCAAATCGCCCAATCGCTGGCGCACCTGCTGCCGCCAGT<br>GCTGAAAGATAAATTCATCTGCGATCGTCCGCTGGAAGTCCGTC<br>CGGTGGAGTTTCATAACCCACTGAAAGGTCACGTCGCAGAACCA<br>CATCGTCAGGTGTGGATCCGCGCAAATGGTAGCGTGCCGGATGA<br>CCTGCGCGTTCATCAGTATCTGCTCGGTTACGCTTCTGATCTTA<br>ACTTCCTGCCGGTAGCTCTACAGCCGCACGGCATCGGTTTTCTC<br>GAACCGGGGATTCAGATTGCCACCATTGACCATTCCATGTGGTT<br>CCATCGCCCGTTTAATTTGAATGAATGGCTGCTGTATAGCGTGG<br>AGAGCACCTCGGCGTCCAGCGCACGTGGCTTTGTGCGCGGTGAG<br>TTTTATACCCAAGACGGCGTACTGGTTGCCTCGACCGTTCAGGA<br>AGGGGTGATGCGTAATCACAATTAA |
| acuI<br>SEQ ID NO: 16 | ATGCGTGCGGTACTGATCGAGAAGTCCGATGATACACAGTCCGT<br>CTCTGTCACCGAACTGGCTGAAGATCAACTGCCGGAAGGCGACG<br>TTTTGGTAGATGTTGCTTATTCAACACTGAACTACAAAGACGCC<br>CTGGCAATTACCGGTAAAGCCCCCGTCGTTCGTCGTTTTCCGAT<br>GGTACCTGGAATCGACTTTACGGGTACCGTGGCCCAGTCTTCCC<br>ACGCCGACTTCAAGCCAGGTGATCGCGTAATCCTGAATGGTTGG<br>GGTGTGGGGGAAAAACATTGGGGCGGTTTAGCGGAGCGCGCTCG<br>CGTTGCGCGGAGACTGGCTTGTTCCCTTGCCAGCCCCCCTGGACT<br>TACGCCAAGCGGCCATGATCGGTACAGCAGGATACACGGCGATG<br>TTGTGCGTTCTGGCGCTTGAACGTCACGGAGTGGTGCCGGGTAA<br>TGGGGAAATCGTGGTGTCCGGTGCAGCAGGCGGCGTCGGCTCCG<br>TTGCGACGACCCTTCTTGCCGCTAAGGGCTATGAGGTAGCGGCA<br>GTGACTGGACGTGCGTCCGAAGCAGAATATCTGCGCGGTTTGG<br>GGCGGCGAGCGTAATTGATCGTAACGAATTAACGGGGAAGGTAC<br>GCCCGCTGGGTCAGGAGCGTTGGGCTGGCGGGATTGACGTGGCG<br>GGATCAACCGTGCTTGCGAACATGCTTTCTATGATGAAGTATCG<br>CGGGGTAGTCGCTGCGTGTGGCCTGGCCGCGGGCATGGATCTGC<br>CCGCGTCTGTCGCGCCCTTTATTCTTCGTGGGATGACGCTGGCA<br>GGGGTGGATAGCGTTATGTGCCCAAAGACAGATCGTTTAGCAGC<br>GTGGGCCCGTTTGGCGTCAGATCTTGACCCTGCCAAGCTGGAGG<br>AGATGACTACAGAGTTGCCGTTTAGTGAAGTAATCGAGACAGCA<br>CCCAAATTCTTGGACGGGACGGTTCGTGGCCGCATTGTTATCCC<br>CGTAACGCCCTAA |

TABLE 3

Propionate Cassette Sequences
Sleeping Beauty Operon

| Sbm<br>SEQ<br>ID<br>NO: 17 | ATGTCTAACGTGCAGGAGTGGCAACAGCTTGCCAACAAGGAAT<br>TGAGCCGTCGGGAGAAAACTGTCGACTCGCTGGTTCATCAAAC<br>CGCCGGAAGGGATCGCCATCAAGCCGCTGTATACCGAAGCCGAT<br>CTCGATAATCTGGAGGTGACAGGTACCCTTCCTGGTTTGCCGC<br>CCTACGTTCGTGGCCCGCGTGCCACTATGTATACCGCCCAACC<br>GTGGACCATCCGTCAGTATGCTGGTTTTTCAACAGCAAAAGAG<br>TCCAACGCTTTTTATCGCCGTAACCTGGCCGCCGGGCAAAAAG<br>GTCTTTCCGTTGCGTTTGACCTTGCCACCCACCGTGGCTACGA<br>CTCCGATAACCCGCGCGTGGCGGGCGACGTCGGCAAAGCGGGC<br>GTCGCTATCGACACCGTGGAAGATATGAAAGTCCTGTTCGACC<br>AGATCCCGCTGGATAAAATGTCGGTTTCGATGACCATGAATGG<br>CGCAGTGCTACCAGTACTGGCGTTTTATATCGTCGCCGCAGAA<br>GAGCAAGGTGTTACACCTGATAAACTGACCGGCACCATTCAAA<br>ACGATATTCTCAAAGAGTACCTCTGCCGCAACACCTATATTTA<br>CCCACCAAAACCGTCAATGCGCATTATCGCCGACATCATCGCC<br>TGGTGTTCCGGCAACATGCCGCGATTTAATACCATCAGTATCA<br>GCGGTTACCACATGGGTGAAGCGGGTGCCAACTGCGTGCAGCA<br>GGTAGCATTTACGCTCGCTGATGGGATTGAGTACATCAAAGCA<br>GCAATCTCTGCCGGACTGAAAATTGATGACTTCGCTCCTCGCC<br>TGTCGTTCTTCTTCGGCATCGGCATGGATCTGTTTATGAACGT<br>CGCCATGTTGCGTGCGGCACGTTATTTATGGAGCGAAGCGGTC<br>AGTGGATTTGGCGCACAGGACCCGAAATCACTGGCGCTGCGTA<br>CCCACTGCCAGACCTCAGGCTGGAGCCTGACTGAACAGGATCC<br>GTATAACAACGTTATCCGCACCACCATTGAAGCGCTGGCTGCG<br>ACGCTGGGCGGTACTCAGTCACTGCATACCAACGCCTTTGACG<br>AAGCGCTTGGTTTGCCTACCGATTTCTCAGCACGCATTGCCCG<br>CAACACCCAGATCATCATCCAGGAAGAATCAGAACTCTGCCGC<br>ACCGTCGATCCACTGGCCGGATCCTATTCATTGAGTCGCTGA<br>CCGATCAAATCGTCAAACAAGCCAGAGCTATTATCCAACAGAT<br>CGACGAAGCCGGTGGCATGGCGCAAAGCGATCGAAGCAGGTCTG<br>CCAAAACGAATGATCGAAGAGGCCTCAGCGCGCGAACAGTCGA<br>TGATCGACCAGGGCAAGCGTGTCATCGTTGGTGTCAACAAGTA<br>CAAACTGGATCACGAAGACGAAACCGATGTACTTGAGATCGAC<br>AACGTGATGGTGCGTAACGAGCAAATTGCTTCGCTGGAACGCA<br>TTCGCGCCACCCGTGATGATGCCGCCGTAACCGCCGCGTTGAA<br>CGCCCTGACTCACGCCGCACAGCATAACGAAAACCTGCTGGCT<br>GCCGCTGTTAATGCCGCTCGCGTTCGCGCCACCCTGGGTGAAA<br>TTTCCGATGCGCTGGAAGTCGCTTTCGACCGTTATCTGGTGCC<br>AAGCCAGTGTGTTACCGGCGTGATTGCGCAAAGCTATCATCAG<br>TCTGAGAAATCGGCCTCCGAGTTCGATGCCATTGTTGCGCAAA<br>CGGAGCAGTTCCTTGCCGACAATGGTCGTCGCCCGCGCATTCT<br>GATCGCTAAGATGGGCCAGGATGGACACGATCGCGGCGCGAAA<br>GTGATCGCCAGCGCCTATTCCGATCTCGGTTTCGACGTAGATT<br>TAAGCCCGATGTTCTCTACACCTGAAGAGATCGCCCGCCTGGC<br>CGTAGAAAACGACGTTCACGTAGTGGGCGCATCCTCACTGGCT<br>GCCGGTCATAAAACGCTGATCCCGGAACTGGTCGAAGCGCTGA |

TABLE 3-continued

Propionate Cassette Sequences
Sleeping Beauty Operon

AAAAATGGGGACGCGAAGATATCTGCGTGGTCGCGGGTGGCGT
CATTCCGCCGCAGGATTACGCCTTCCTGCAAGAGCGCGGCGTG
GCGGCGATTTATGGTCCAGGTACACCTATGCTCGACAGTGTGC
GCGACGTACTGAATCTGATAAGCCAGCATCATGATTAA ygfD
SEQ
ID
NO: 18

ATGATTAATGAAGCCACGCTGGCAGAAAGTATTCGCCGCTTAC
GTCAGGGTGAGCGTGCCACACTCGCCCAGGCCATGACGCTGGT
GGAAAGCCGTCACCCGCGTCATCAGGCACTAAGTACGCAGCTG
CTTGATGCCATTATGCCGTACTGCGGTAACACCCTGCGACTGG
GCGTTACCGGCACCCCCGGCGCGGGGAAAAGTACCTTTCTTGA
GGCCTTTGGCATGTTGTTGATTCGAGAGGGATTAAAGGTCGCG
GTTATTCGGTCGATCCCAGCAGCCCGGTCACTGGCGGTAGCA
TTCTCGGGATAAAACCCGCATGAATGACCTGGCGCGTGCCGA
AGCGGCGTTTATTCGCCCGGTACCATCCTCCGGTCATCTGGGC
GGTGCCAGTCAGCGAGCGCGGGAATTAATGCTGTTATGCGAAG
CAGCGGGTTATGACGTAGTGATTGTCGAAACGGTTGGCGTCGG
GCAGTCGGAAACAGAAGTCGCCCGCATGGTGGACTGTTTTATC
TCGTTGCAAATTGCCGGTGGCGGCGCAGATCTGCAGGGCATTA
AAAAAGGGCTGATGAAGTGGCTGATCTGATCGTTATCAACAA
AGACGATGGCGATAACCATACCAATGTCGCCATTGCCCGGCAT
ATGTACGAGAGTGCCCTGCATATTCTGCGACGTAAATACGACG
AATGGCGACCACGGGTTCTGACTTGTTAGCGCACTGGAAAAACG
TGGAATCGATGAGATCTGGCACGCCATCATCGACTTCAAAACC
GCGCTAACTGCCAGTGGTCGTTTACAACAAGTGCGGCAACAAC
AATCGGTGGAATGGCTGCGTAAGCAGACCGAAGAAGAAGTACT
GAATCACCTGTTCGCGAATGAAGATTTCGATCGTATTACCGC
CAGACGCTTTTAGCGGTCAAAAACAATACGCTCTCACCGCGCA
CCGGCCTGCGGCAGCTCAGTGAATTTATCCAGACGCAATATTT
TGATTAA ygfG
SEQ
ID
NO: 19

ATGTCTTATCAGTATGTTAACGTTGTCACTATCAACAAAGTGG
CGGTCATTGAGTTTAACTATGGCCGAAAACTTAATGCCTTAAG
TAAAGTCTTTATTGATGATCTTATGCAGGCGTTAAGCGATCTC
AACCGGCCGGAAATTCGCTGTATCATTTTGCGCGCACCGAGTG
GATCCAAAGTCTTTCTCCGCAGGTCACGATATTCACGAACTGCC
GTCTGGCGGTCGCGATCCGCTCTCCTATGATGATCCATTGCGT
CAAATCACCCGCATGATCCAAAAATTCCCGAAACCGATCATTT
CGATGGTGGAAGGTAGTGTTTGGGGTGGCGCATTTGAAATGAT
CATGAGTTCCGATCTGATCATCGCCGCCAGTACCTCAACCTT
TCAATGACGCCTGTAAACCTCGGCGTCCCGTATAACCTGGTCG
GCATTCACAACCTGACCCGCGACGCGGGCTTCCACATTGTCAA
AGAGCTGATTTTTACCGCTTCGCCAATCACCGCCCAGCGCGCG
CTGGCTGTCGGCATCCTCAACCATGTTGTGGAAGTGGAAGAAC

TGGAAGATTTCACCTTACAAATGGCGCACCACATCTCTGAGAA
AGCGCCGTTAGCCATTGCCGTTATCAAAGAAGAGCTGCGTGTA
CTGGGCGAAGCACACACCATGAACTCCGATGAATTTGAACGTA
TTCAGGGGATGCGCCGCGCGGTGTATGACAGCGAAGATTACCA
GGAAGGGATGAACGCTTTCCTCGAAAAACGTAAACCTAATTTC
GTTGGTCATTAA ygfH
SEQ
ID
NO: 20

ATGGAAACTCAGTGGACAAGGATGACCGCCAATGAAGCGGCAG
AAATTATCCAGCATAACGACATGGTGGCATTTAGCGGCTTTAC
CCCGGCGGGTTCGCCGAAAGCCCTACCCACCGCGATTGCCCGC
AGAGCTAACGAACAGCATGAGGCCAAAAAGCCGTATCAAATTC
GCCTTCTGACGGGTGCGTCAATCAGCGCCGCCGCTGACGATGT
ACTTTCTGACGCCGATGCTGTTTCCTGGCGTGCGCCATATCAA
ACATCGTCCGGTTTACGTAAAAAGATCAATCAGGGCGCGGTGA
GTTTCGTTGACCTGCATTTGAGCGAAGTGGCGCAAATGGTCAA
TTACGGTTTCTTCGGCGACATTGATGTTGCCGTCATTGAAGCA
TCGGCACTGGCACCGGATGGTCGAGTCTGGTTAACCAGCGGGA
TCGGTAATGCGCCGACCTGGCTGCTGCGGGCGAAGAAAGTGAT
CATTGAACTCAATCACTATCACGATCCGCGCGTTGCAGAACTG
GCGGATATTGTGATTCCTGGCGCGCCACCGCGGCGCAATAGCG
TGTCGATCTTCCATGCAATGGATCGCGTCGGTACCCGCTATGT
GCAAATCGATCCGAAAAAGATTGTCGCGCTCGTGAGAACCAAC
TTGCCCGACGCCGGTAATATGCTGGATAAGCAAAATCCCATGT
GCCAGCAGATTGCCGATAACGTGGTCACGTTCTTATTGCAGGA
AATGGCGCATGGGCGTATTCCGCCGGAATTTCTGCCGCTGCAA
AGTGGCGTGGGCAATATCAATAATGCGGTAATGGCGCGTCTGG
GGGAAAAACCCGGTAATTCCTCCGTTTATGATGTATTCGGAAGT
GCTACAGGAATCGGTGGTCATTTACTGGAAACCGGCAAAATC
AGCGGGGCCAGCGCCTCCAGCCTGACAATCTCGGCCGATTCCC
TGCGCAAGATTTACGACAATATGGATTACTTTGCCAGCCGCAT
TGTGTTGCGTCCGCAGGAGATTTCCAATAACCCGGAAATCATC
CGTCGTCTGGGCGTCATCGCTCTGAACGTCGGCCTGGAGTTTG
ATATTTACGGGCATGCCAACTCAACACACGTAGCCGGGGTCGA
TCTGATGAACGGCATCGGCGGCAGCGGTGATTTTGAACGCAAC
GCGTATCTGTCGATCTTTATGGCCCCGTCGATTGCTAAAGAAG
GCAAGATCTCAACCTCGTGCCAATGTGCAGCCATGTTGATCA
CAGCGAACACAGCGTCAAAGTGATCATCACCGAACAAGGGATC
GCCGATCTGCGCGGTCTTTCCCCGCTTCAACGCGCCCGCACTA
TCATTGATAATTGTGCACATCCTATGTATCGGGATTATCTGCA
TCGCTATCTGGAAAATGCGCCTGGCGGACATATTCACCACGAT
CTTAGCCACGTCTTCGACTTACACCGTAATTTAATTGCAACCG
GCTCGATGCTGGGTTAA

TABLE 4

Sequences of Propionate Cassette from Propioni Bacteria

| Description | Sequence |
|---|---|
| mutA<br>SEQ ID NO: 21 | ATGAGCAGCACGGATCAGGGGACCAACCCCGCCGACACTGACG<br>ACCTCACTCCCACCACACTCAGTCTGGCCGGGGATTTCCCCAA<br>GGCCACTGAGGAGCAGTGGGAGCGCGAAGTTGAGAAGGTATTC<br>AACCGTGGTCGTCCACCGGAGAAGCAGCTGACCTTCGCCGAGT<br>GTCTGAAGCGCCTGACGGTTCACACCGTCGATGGCATCGACAT<br>CGTGCCGATGTACCGTCCGAAGGACGCGCCGAAGAAGCTGGGT<br>TACCCCGGCGTCACCCCCTTCACCCGCGGCACCACGGTGCGCA<br>ACGGTGACATGGATGCCTGGGACGTGCGCGCCCTGCACGAGGA<br>TCCCGACGAGAAGTTCACCCGCAAGGCGATCCTTGAAGACCTG<br>GAGCGTGGCGTCACCTCCCTGTTGTTGCGCGTTGATCCCGACG<br>CGATCGCACCCGAGCACCTCGACGAGGTCCTCTCCGACGTCCT<br>GCTGGAAATGACCAAGGTGGAGGTCTTCAGCCGCTACGACCAG<br>GGTGCCGCCGCCGAGGCCTTGATGGGCGTCTACGAGCGCTCCG<br>ACAAGCCGGCGAAGGACCTGGCCCTGAACCTGGGCCTGGATCC<br>CATCGGCTTCGCGGCCCTGCAGGGCACCGAGCCGGATCTGACC<br>GTGCTCGGTGACTGGGTGCGCCGCCTGGCGAAGTTCTCACCGG<br>ACTCGCGCGCCGTCACGATCGACGCGAACGTCTACCACAACGC<br>CGGTGCCGGCGACGTGGCAGAGCTCGCTTGGGCACTGGCCACC<br>GGCGCGGAGTACGTGCGCGCCCTGGTCGAACAGGGCTTCAACG<br>CCACAGAGGCCTTCGACACGATCAACTTCCGTGTCACCGCCAC<br>CCACGACCAGTTCCTCACGATCGCCCGTCTTCGCGCCCTGCGC<br>GAGGCATGGGCCCGCATCGGCGAGGTCTTTGGCGTGGACGAGG<br>ACAAGCGCGGCGCTCGCCAGAATGCGATCACCAGTTGGCGTGA<br>GCTCACCCGCGAAGACCCCTATGTCAACATCCTTCGCGGTTCG<br>ATTGCCACCTTCTCCGCCTCCGTTGGCGGGGCCGAGTCGATCA |

TABLE 4-continued

Sequences of Propionate Cassette from Propioni Bacteria

| Description | Sequence |
|---|---|
| | CGACGCTGCCCTTCACCCAGGCCCTCGGCCTGCCGGAGGACGA |
| | CTTCCCGCTGCGCATCGCGCGCAACACGGGCATCGTGCTCGCC |
| | GAAGAGGTGAACATCGGCCGCGTCAACGACCCGGCCGGTGGCT |
| | CCTACTACGTCGAGTCGCTCACTCGCACCCTGGCCGACGCTGC |
| | CTGGAAGGAATTCCAGGAGGTCGAGAAGCTCGGTGGCATGTCG |
| | AAGGCGGTCATGACCGAGCACGTCACCAAGGTGCTCGACGCCT |
| | GCAATGCCGAGCGCGCCAAGCGCCTGGCCAACCGCAAGCAGCC |
| | GATCACCGCGGTCAGCGAGTTCCCGATGATCGGGGCCCGCAGC |
| | ATCGAGACCAAGCCGTTCCCAACCGCTCCGGCGCGCAAGGGCC |
| | TGGCCTGGCATCGCGATTCCGAGGTGTTCGAGCAGCTGATGGA |
| | TCGCTCCACCAGCGTCTCCGAGCGCCCCAAGGTGTTCCTTGCC |
| | TGCCTGGGCACCCGTCGCGACTTCGGTGGCCGCGAGGGCTTCT |
| | CCAGCCCGGTATGGCACATCGCCGGTATCGACACCCCGCAGGT |
| | CGAAGGCGGCACCACCGCCGAGATCGTCGAGGCGTTCAAGAAG |
| | TCGGGCGCCCAGGTGGCCGATCTCTGCTCGTCCGCCAAGATCT |
| | ACGCGCAGCAGGGACTTGAGGTTGCCAAGGCGCTCAAGGCCGC |
| | CGGCGCGAAGGCCCTGTATCTGTCGGGCGCCTTCAAGGAGTTC |
| | GGCGATGACGCCGCCGAGGCCGAGAAGCTGATCGACGGACGCC |
| | TGTACATGGGCATGGATGTCGTCGACACCCTGTCCTCCACCCT |
| | TGATATCTTGGGAGTCGCGAAGTGA |
| mutB SEQ ID NO: 22 | GTGAGCACTCTGCCCCGTTTTGATTCAGTTGACCTGGGCAATG |
| | CCCCGGTTCCTGCTGATGCCGCACAGCGCTTCGAGGAGTTGGC |
| | CGCCAAGGCCGGCACCGAAGAGGCGTGGGAGACGGCTGAGCAG |
| | ATTCCGGTTGGCACCCTGTTCAACGAAGACGTCTACAAGGACA |
| | TGGACTGGCTGGACACCTACGCCGGTATCCCGCCGTTCGTCCA |
| | CGGCCCATATGCAACCATGTACGCGTTCCGTCCCTGGACGATT |
| | CGCCAGTACGCCGGCTTCTCCACGGCCAAGGAGTCCAACGCCT |
| | TCTACCGCCGCAACCTTGCGGCGGGCCAGAAGGGCCTGTCGGT |
| | TGCCTTCGACCTGCCCACCCACCGCGGCTACGACTCGGACAAT |
| | CCCCGCGTCGCCGGTGACGTCGGCATGGCCGGGGTGGCCATCG |
| | ACTCCATCTATGACATGCGCGAGCTGTTCGCCGGCATTCCGCT |
| | GGACCAGATGAGCGTGTCGATGACCATGAACGGCGCCGTGCTG |
| | CCGATCCTGGCCCTCTATGTGGTGACCGCCGAGGAGCAGGGCG |
| | TCAAGCCCGAGCAGCTCGCCGGGACGATCCAGAACGACATCCT |
| | CAAGGAGTTCATGGTTCGTAACACCTATATCTACCCGCCGCAG |
| | CCGAGTATGCGAATCATCTCCGAGATCTTCGCCTACACGAGTG |
| | CCAATATGCCGAAGTGGAATTCGATTTCCATTTCCGGCTACCA |
| | CATGCAGGAAGCCGGCGCCACGGCCGACATCGAGATGGCCTAC |
| | ACCCTGGCCGACGGTGTCGACTACATCCGCGCCGGCGAGTCGG |
| | TGGGCCTCAATGTCGACCAGTTCGCGCCGCGTCTGTCCTTCTT |
| | CTGGGGCATCGGCATGAACTTCTTCATGGAGGTTGCCAAGCTG |
| | CGTGCCGCACGTATGTTGTGGGCCAAGCTGGTGCATCAGTTCG |
| | GGCCGAAGAATCCGAAGTCGATGAGCCTGCGCACCCACTCGCA |
| | GACCTCCGGTTGGTCGCTGACCGCCCAGGACGTCTACAACAAC |
| | GTCGTGCGTACCTGCATCGAGGCCATGGCCGCCACCCAGGGCC |
| | ATACCCAGTCGCTGCACACGAACTCGCTCGACGAGGCCATTGC |
| | CCTACCGACCGATTTCAGCGCCCGCATCGCCCGTAACACCCAG |
| | CTGTTCCTGCAGCAGGAATCGGGCACGACGCGCGTGATCGACC |
| | CGTGGAGCGGCTCGGCATACGTCGAGGAGCTCACCTGGGACCT |
| | GGCCCGCAAGGCATGGGGCCACATCCAGGAGGTCGAGAAGGTC |
| | GGCGGCATGGCCAAGGCCATCGAAAAGGGCATCCCCAAGATGC |
| | GCATTGAGGAAGCCGCCGCCCGCACCCAGGCACGCATCGACTC |
| | CGGCCGTCAGCCGCTGATCGGCGTGAACAAGTACCGCCTGGAG |
| | CACGAGCCGCCGCTCGATGTGCTCAAGGTTGACAACTCCACGG |
| | TGCTCGCCGAGCAGAAGGCCAAGCTGGTCAAGCTGCGCGCCGA |
| | GCGCGATCCCGAGAAGGTCAAGGCCGCCCTCGACAAGATCACC |
| | TGGGCTGCCGCCAACCCCGACGACAAGGATCCGGATCGCAACC |
| | TGCTGAAGCTGTGCATCGACGCTGGCCGCGCCATGGCGACGGT |
| | CGGCGAGATGAGCGACGCGCTCGAGAAGGTCTTCGGACGCTAC |
| | ACCGCCCAGATTCGCACCATCTCCGGTGTGTACTCGAAGGAAG |
| | TGAAGAACACGCCTGAGGTTGAGGAAGCACGCGAGCTCGTTGA |
| | GGAATTCGAGCAGGCCGAGGGCCGTCGTCCTCGCATCCTGCTG |
| | GCCAAGATGGGCCAGGACGGTCACGACCGTGGCCAGAAGGTCA |
| | TCGCCACCGCCTATGCCGACCTCGGTTTCGACGTCGACGTGGG |
| | CCCGCTGTTCCAGACCCCGGAGGAGACCGCACGTCAGGCCGTC |
| | GAGGCCGATGTGCACGTGGTGGGCGTTTCGTCGCTCGCCGGCG |
| | GGCATCTGACGCTGGTTCCGGCCCTGCGCAAGGAGCTGGACAA |
| | GCTCGGACGTCCCGACATCCTCATCACCGTGGGCGGCGTGATC |
| | CCTGAGCAGGACTTCGACGAGCTGCGTAAGGACGGCGCCGTGG |
| | AGATCTACACCCCCGGCACCGTCATTCCGGAGTCGGCGATCTC |
| | GCTGGTCAAGAAACTGCGGGCTTCGCTCGATGCCTAG |
| GI: 18042134 SEQ ID NO: 23 | ATGAGTAATGAGGATCTTTTCATCTGTATCGATCACGTGGCAT |
| | ATGCGTGCCCCGACGCCGACGAGGCTTCCAAGTACTACCAGGA |
| | GACCTTCGGCTGGCATGAGCTCCACCGCGAGGAGAACCCGGAG |

TABLE 4-continued

Sequences of Propionate Cassette from Propioni Bacteria

| Description | Sequence |
|---|---|
| | CAGGGAGTCGTCGAGATCATGATGGCCCCGGCTGCGAAGCTGA
CCGAGCACATGACCCAGGTTCAGGTCATGGCCCCGCTCAACGA
CGAGTCGACCGTTGCCAAGTGGCTTGCCAAGCACAATGGTCGC
GCCGGACTGCACCACATGGCATGGCGTGTCGATGACATCGACG
CCGTCAGCGCCACCCTGCGCGAGCGCGGCGTGCAGCTGCTGTA
TGACGAGCCCAAGCTCGGCACCGGCGGCAACCGCATCAACTTC
ATGCATCCCAAGTCGGGCAAGGGCGTGCTCATCGAGCTCACCC
AGTACCCGAAGAACTGA |
| mmdA
SEQ ID NO: 24 | ATGGCTGAAAACAACAATTTGAAGCTCGCCAGCACCATGGAAG
GTCGCGTGGAGCAGCTCGCAGAGCAGCGCCAGGTGATCGAAGC
CGGTGGCGGCGAACGTCGCGTCGAGAAGCAACATTCCCAGGGT
AAGCAGACCGCTCGTGAGCGCCTGAACAACCTGCTCGATCCCC
ATTCGTTCGACGAGGTCGGCGCTTTCCGCAAGCACCGCACCAC
GTTGTTCGGCATGGACAAGGCCGTCGTCCCGGCAGATGGCGTG
GTCACCGGCCGTGGCACCATCCTTGGTCGTCCCGTGCACGCCG
CGTCCCAGGACTTCACGGTCATGGGTGGTTCGGCTGGCGAGAC
GCAGTCCACGAAGGTCGTCGAGACGATGGAACAGGCGCTGCTC
ACCGGCACGCCCTTCCTGTTCTTCTACGATTCGGGCGGCGCCC
GGATCCAGGAGGGCATCGACTCGCTGAGCGGTTACGGCAAGAT
GTTCTTCGCCAACGTGAAGCTGTCGGGCGTCGTGCCGCAGATG
GCCATCATTGCCGGCCCCTGTGCCGGTGGCGCCTCGTATTCGC
CGGCACTGACTGACTTCATCATCATGACCAAGAAGGCCCATAT
GTTCATCACGGGCCCCCAGGTCATCAAGTCGGTCACCGGCGAG
GATGTCACCGCTGACGAACTCGGTGGCGCTGAGGCCCATATGG
CCATCTCGGGCAATATCCACTTCGTGGCCGAGGACGACGACGC
CGCGGAGCTCATTGCCAAGAAGCTGCTGAGCTTCCTTCCGCAG
AACAACACTGAGGAAGCATCCTTCGTCAACCCGAACAATGACG
TCAGCCCCAATACCGAGCTGCGCGACATCGTTCCGATTGACGG
CAAGAAGGGCTATGACGTGCGCGATGTCATTGCCAAGATCGTC
GACTGGGGTGACTACCTCGAGGTCAAGGCCGGCTATGCCACCA
ACCTCGTGACCGCCTTCGCCCGGGTCAATGGTCGTTCGGTGGG
CATCGTGGCCAATCAGCCGTCGGTGATGTCGGGTTGCCTCGAC
ATCAACGCCCTCTGACAAGGCCGCCGAATTCGTGAATTTCTGCG
ATTCGTTCAACATCCCGCTGGTGCAGCTGGTCGACGTGCCGGG
CTTCCTGCCCGGCGTGCAGCAGGAGTACGGCGGCATCATTCGC
CATGGCGCGAAGATGCTGTACGCCTACTCCGAGGCCACCGTGC
CGAAGATCACCGTGGTGCTCCGCAAGGCCTACGGCGGCTCCTA
CCTGGCCATGTGCAACCGTGACCTTGGTGCCGACGCCGTGTAC
GCCTGGCCCAGCGCCGAGATTGCGGTGATGGGCGCCGAGGGTG
CGGCAAATGTGATCTTCCGCAAGGAGATCAAGGCTGCCGACGA
TCCCGACGCCATGCGCGCCGAGAAGATCGAGGAGTACCAGAAC
GCGTTCAACACGCCGTACGTGGCCGCCGCCCGCGGTCAGGTCG
ACGACGTGATTGACCCGGCTGATACCCGTCGAAAGATTGCTTC
CGCCCTGGAGATGTACGCCACCAAGCGTCAGACCCGCCCGGCG
AAGAAGCATGGAAACTTCCCCTGCTGA |
| PFREUD_18870
SEQ ID NO: 25 | ATGAGTCCGCGAGAAATTGAGGTTTCCGAGCCGCGCGAGGTTG
GTATCACCGAGCTCGTGCTGCGCGATGCCCATCAGAGCCTGAT
GGCCACACGAATGGCAATGGAAGACATGGTCGGCGCCTGTGCA
GACATTGATGCTGCCGGGTACTGGTCAGTGGAGTGTTGGGGTG
GTGCCACGTATGACTCGTGTATCCGCTTCCTCAACGAGGATCC
TTGGGAGCGTCTGCGCACGTTCCGCAAGCTGATGCCCAACAGC
CGTCTCCAGATGCTGCTGCGTGGCCAGAACCTGCTGGGTTACC
GCCACTACAACGACGAGGTCGTCGATCGCTTCGTCGACAAGTC
CGCTGAGAACGGCATGGACGTGTTCCGTGTCTTCGACGCCATG
AATGATCCCCGCAACATGGCGCACGCCATGGCTGCCGTCAAGA
AGGCCGGCAAGCACGCGCAGGGCACCATTTGCTACACGATCAG
CCCGGTCCACACCGTTGAGGGCTATGTCAAGCTTGCTGGTCAG
CTGCTCGACATGGGTGCTGATTCCATCGCCCTGAAGGACATGG
CCGCCCTGCTCAAGCCGCAGCCGGCCTACGACATCATCAAGGC
CATCAAGGACACCTACGGCCAGAAGACGCAGATCAACCTGCAC
TGCCACTCCACCACGGGTGTCACCGAGGTCTCCCTCATGAAGG
CCATCGAGGCCGGCGTCGACGTCGTCGACACCGCCATCTCGTC
CATGTCGCTCGGCCCGGGCCACAACCCCACCGAGTCGGTTGCC
GAGATGCTCGAGGGCACCGGGTACACCACCAACCTTGACTACG
ATCGCCTGCACAAGATCCGCGATCACTTCAAGGCCATCCGCCC
GAAGTACAAGAAGTTCGAGTCGAAGACGCTTGTCGACACCTCG
ATCTTCAAGTCGCAGATCCCCGGCGGCATGCTCTCCAACATGG
AGTCGCAGCTGCGCGCCCAGGGCGCCGAGGACAAGATGGACGA
GGTCATGGCAGAGGTGCCGCGCGTCCGCAAGGCCGCCGGCTTC
CCGCCCCTGGTCACCCCGTCCAGCCAGATCGTCGGCACGCAGG
CCGTGTTCAACGTGATGATGGGCGAGTACAAGAGGATGACCGG
CGAGTTCGCCGACATCATGCTCGGCTACTACGGCGCCAGCCCG
GCCGATCGCGATCCGAAGGTGGTCAAGTTGGCCGAGGAGCAGT
CCGGCAAGAAGCCGATCACCCAGCGCCCGGCCGATCTGCTGCC |

TABLE 4-continued

Sequences of Propionate Cassette from Propioni Bacteria

| Description | Sequence |
|---|---|
| | CCCCGAGTGGGAGGAGCAGTCCAAGGAGGCCGCGGCCCTCAAG<br>GGCTTCAACGGCACCGACGAGGACGTGCTCACCTATGCACTGT<br>TCCCGCAGGTCGCTCCGGTCTTCTTCGAGCATCGCGCCGAGGG<br>CCCGCACAGCGTGGCTCTCACCGATGCCCAGCTGAAGGCCGAG<br>GCCGAGGGCGACGAGAAGTCGCTCGCCGTGGCCGGTCCCGTCA<br>CCTACAACGTGAACGTGGGCGGAACCGTCCGCGAAGTCACCGT<br>TCAGCAGGCGTGA |
| Bccp<br>SEQ ID NO: 26 | ATGAAACTGAAGGTAACAGTCAACGGCACTGCGTATGACGTTG<br>ACGTTGACGTCGACAAGTCACACGAAAACCCGATGGGCACCAT<br>CCTGTTCGGCGGCGGCACCGGCGGCGCGCCGGCACCGCGCGCA<br>GCAGGTGGCGCAGGCGCCGGTAAGGCCGGAGAGGGCGAGATTC<br>CCGCTCCGCTGGCCGGCCACCGTCTCCAAGATCCTCGTGAAGGA<br>GGGTGACACGGTCAAGGCTGGTCAGACCGTGCTCGTTCTCGAG<br>GCCATGAAGATGGAGACCGAGATCAACGCTCCCACCGACGGCA<br>AGGTCGAGAAGGTCCTTGTCAAGGAGCGTGACGCCGTGCAGGG<br>CGGTCAGGGTCTCATCAAGATCGGCTGA |

In some embodiments, the genetically engineered bacteria comprise one or more nucleic acid sequence(s) of Table 4 (SEQ ID NO: 21-SEQ ID NO: 26) or a functional fragment thereof. In some embodiments, the genetically engineered bacteria comprise a nucleic acid sequence that, but for the redundancy of the genetic code, encodes the same polypeptide as one or more nucleic acid s sequence(s) of Table 4 (SEQ ID NO: 21-SEQ ID NO: 26) or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of one or more nucleic acid sequence(s) of Table 4 (SEQ ID NO: 21-SEQ ID NO: 26) or a functional fragment thereof, or a nucleic acid sequence that, but for the redundancy of the genetic code, encodes the same polypeptide as one or more nucleic acid sequence(s) of Table 4 (SEQ ID NO: 21-SEQ ID NO: 26) or a functional fragment thereof.

Table 5 lists exemplary polypeptide sequences, which may be encoded by the propionate production gene(s) or cattette(s) of the genetically engineered bacteria.

TABLE 5

| Polypeptide Sequences for Propionate Synthesis | |
|---|---|
| Pct<br>SEQ ID<br>NO: 27 | MRKVPIITADEAAKLIKDGDTVTTSGFVGNAIPEALDRAVEKRFLET<br>GEPKNITYVYCGSQGNRDGRGAEHFAHEGLLKRYIAGHWATVPALGK<br>MAMENKMEAYNVSQGALCHLFRDIASHKPGVFTKVGIGTFIDPRNGG<br>GKVNDITKEDIVELVEIKGQEYLFYPAFPIHVALIRGTYADESGNIT<br>FEKEVAPLEGTSVCQAVKNSGGIVVVQVERVVKAGTLDPRHVKVPGI<br>YVDYVVVADPEDHQQSLDCEYDPALSGEHRRPEVVGEPLPLSAKKVI<br>GRRGAIELEKDVAVNLGVGAPEYVASVADEEGIVDFMTLTAESGAIG<br>GVPAGGVRFGASYNADALIDQGYQFDYYDGGGLDLCYLGLAECDEKG<br>NINVSRFGPRIAGCGGFINITQNTPKVFFCGTFTAGGLKVKIEDGKV<br>IIVQEGKQKKFLKAVEQITFNGDVALANKQQVTYITERCVFLLKEDG<br>LHLSEIAPGIDLQTQILDVMDFAPIIDRDANGQIKLMDAALFAEGLM<br>GLKEMKS* |
| lcdA<br>SEQ ID<br>NO: 28 | MSLTQGMKAKQLLAYFQGKADQDAREAKARGELVCWSASVAPPEFCV<br>TMGIAMIYPETHAAGIGARKGAMDMLEVADRKGYNVDCCSYGRVNMG<br>YMECLKEAAITGVKPEVLVNSPAADVPLPDLVITCNNICNTLLKWYE<br>NLAAELDIPCIVIDVPFNHTMPIPEYAKAYIADQFRNAISQLEVICG<br>RPFDWKKFKEVKDQTQRSVYHWNRIAEMAKYKPSPLNGFDLFNYMAL<br>IVACRSLDYAEITFKAFADELEENLKAGIYAFKGAEKTRFQWEGIAV<br>WPHLGHTFKSMKNLNSTMTGTAYPALWDLHYDANDESMHSMAEAYTR<br>IYINTCLQNKVEVLLGIMEKGQVDGTVYHLNRSCKLMSFLNVETAEI<br>IKEKNGLPYVSIDGDQTDPRVFSPAQFDTRVQALVEMMEANMAAAE* |
| lcdB<br>SEQ ID<br>NO: 29 | MSRVEAILSQLKDVAANPKKAMDDYKAETGKGAVGIMPIYSPEEMVH<br>AAGYLPMGIWGAQGKTISKARTYLPAFACSVMQQVMELQCEGAYDDL<br>SAVIFSVPCDTLKCLSQKWKGTSPVIVFTHPQNRGLEAANQFLVTEY<br>ELVKAQLESVLGVKISNAALENSIAIYNENRAVMREFVKVAADYPQV<br>IDAVSRHAVFKARQFMLKEKHTALVKELIAEIKATPVQPWDGKKVVV<br>TGILLEPNELLDTFNEFKIATVDDDLAQESRQTRVDVLDGEGGPLYR<br>MAKAWQQMYGCSLATDTKKGRGRMLINKTIQTGADATVVAMMKFCDP<br>EEWDYPVMYREFEEKGVKSLMIEVDQEVSSFEQIKTRLQSFVEML* |
| lcdC<br>SEQ ID<br>NO: 30 | MYTLGIDVGSASSKAVILKDGKDIVAAEVVQVGTGSSGPQRALDKAFE<br>VSGLKKEDISYTVATGYGRFNFSDADQISEISHAKGIYFLVPTART<br>IIDIGGQDAKAIRLDDKGGIKQFFMNDKCAAGTGRFLEVMARVLETTL<br>DEMAELDEQATDTAPISSTCTVFAESEVISQLSNGVSRNNTIKGVHLS |

TABLE 5-continued

Polypeptide Sequences for Propionate Synthesis

|  |  |
|---|---|
|  | VASRACGLAYRGGLEKDVVMTGGVAKNAGVVRAVAGVLKTDVIVAPNP<br>QTTGALGAALYAYEAAQKKX |
| etfA<br>SEQ ID<br>NO: 31 | MAFNSADINSFRDIWVFCEQREGKLINTDFELISEGRKLADERGSKL<br>VGILLGHEVEEIAKELGGYGADKVIVCDHPELKFYTTDAYAKVLCDV<br>VMEEKPEVILIGATNIGRDLGPRCAARLHTGLTADCTHLDIDMNKYV<br>DFLSTSSTLDISSMTFPMEDTNLKMTRPAFGGHLMATIICPRFRPCM<br>STVRPGVMKKAEFSQEMAQACQVVTRHVNLSDEDLKTKVTNIVKETK<br>KIVDLIGAEIIVSVGRGISKDVQGGIALAEKLADAFGNGVVGGSRAV<br>IDSGWLPADHQVGQTGKTVHPKVYVALGISGAIQHKAGMQDSELIIA<br>VNKDETAPIFDCADYGITGDLFKIVPMMIDAIKEGKNA* |
| acrB<br>SEQ ID<br>NO: 32 | MRIYVCVKQVPDTSGKVAVNPDGTLNRASMAAIINPDDMSAIEQALK<br>LKDETGCQVTALTMGPPPAEGMLREIIAMGADDGVLISAREFGGSDT<br>FATSQIISAAIHKLGLSNEDMIFCGRQAIDGDTAQVGPQIAEKLSIP<br>QVTYGAGIKKSGDLVLVKRMLEDGYMMIEVETPCLITCIQDKAVKPR<br>YMTLNGIMECYSKPLLVLDYEALKDEPLIELDTIGLKGSPTNIFKSF<br>TPPQKGVGVMLQGTDKEKVEDLVDLMQKHVI* |
| acrC<br>SEQ ID<br>NO: 33 | MFLLKIKKERMKRMDFSLTREQEMLKKLARQFAEIELEPVAEEIDRE<br>HVFPAENFKKMAEIGLTGIGIPKEFGGSGGGTLEKVIAVSEFGKKCM<br>ASASASILSIHLIAPQAIYKYGTKEQKETYLPRLTKGGELGAFALTEPN<br>AGSDAGAVKTTAILDSQTNEYVLNGTKCFISGGGRAGVLVIFALTEP<br>KKGLKGMSAIIVEKGTPGFSIGKVESKMGIAGSETAELIFEDCRVPA<br>ANLLGKEGKGFKIAMEALDGARIGVGAQAIGIAEGAIDLSVKYVHER<br>IQFGKPIANLQGIQWYIADMATKTAAARALVEFAAYLEDAGKPFTKE<br>SAMCKLNASENARFVTNLALQIHGGYGYMKDYPLERMYRDAKITEIY<br>EGTSEIHKVVTAREVMKR* |
| thrAfbr<br>SEQ ID<br>NO: 34 | MRVLKFGGTSVANAERFLRVADILESNARQGQVATVLSAPAKITNHL<br>VAMIEKTISGQDALPNISDAERIFAELLTGLAAAQPGFPLAQLKFTV<br>DQEFAQIKHVLHGISLLGQCPDSINAALICRGEKMSIAIMAGVLEAR<br>GHNVTVIDPVEKLLAVGHYLESTVDIAESTRRIAASRIPADHMVLMA<br>GFTAGNEKGELVVLGRNGSDYSAAVLAACLRADCCEIWTDVDGVYTC<br>DPRQVPDARLLKSMSYQEAMELSYFGAKVLHPRTITPIAQFQIPCLI<br>KNTGNPQAPGTLIGASRDEDELPVKGISNLNNMAMFSVSGPGMKGMV<br>GMAARVFAAMSRARISVVLITQSSSEYSISFCVPQSDCVRAERAMQE<br>EFYLELKEGLLEPLAVTERLAIISVVGDGMRTLRGISAKFFAALARA<br>NINIVAIAQRSSERSISVVVNNDDATTGVRVTHQMLFNTDQVIEVFV<br>IGVGGVGGALLEQLKRQQSWLKNKHIDLRVCGVANSKALLTNVHGLN<br>LENWQEELAQAKEPPFNLGRLIRLVKEYHLLNPVIVDCTSSQAVADQY<br>ADFLREGFHVVTPNKKANTSSMDYYHQLRYAAEKSRRKFLYDTNVGA<br>GLPVIENLQNLLNAGDELMKFSGILSGSLSYIFGKLDEGMSFSEATT<br>LAREMGYTEPDPRDDLSGMDVARKLLILARETGRELELADIEIEPVL<br>PAEFNAEGDVAAFMANLSQLDDLFAARVAKARDEGKVLRYVGNIDED<br>GVCRVKIAEVDGNDPLFKVKNGENALAFYSHYYQPLPLVLRGYGAGN<br>DVTAAGVFADLLRTLSWKLGV* |
| thrB<br>SEQ ID<br>NO: 35 | MVKVYAPASSANMSVGFDVLGAAVTPVDGALLGDVVTVEAAETFSLN<br>NLGRFADKLPSEPRENIVYQCWERFCQELGKQIPVAMTLEKNMPICS<br>GLGSSACSVVAALMAMNEHCGKPLNDTRLLALMGELEGRISCSIHYD<br>NVAPCFLGGMQLMIEENDIISQQVPGFDEWLWVLAYPGIKVSTAEAR<br>AILPAQYRRQDCIAHGRHLAGFIHACYSRQPELAAKLMKDVIAEPYR<br>ERLLPGFRQARQAVAEIGAVASGISGSCPTLFALCDKPETAQRVADW<br>LGKNYLQNQEGFVHICRLDTAGARVLEN* |
| thrC<br>SEQ ID<br>NO: 36 | MKLYNLKDHNEQVSFAQAVTQGLGKNQGLFFPHDLPEFSLTEIDEML<br>KLDFVTRSAKILSAFIGDEIPQEILEERVRAAFAFPAPVANVESDVG<br>CLELFHGPTLAFKDFGGRFMAQMLTHIAGDKPVTILTATSGDTGAAV<br>AHAFYGLPNVKVVILYPRGKISPLQEKLFCTLGGNIETVAIDGDFDA<br>CQALVKQAFDDEELKVALGLNSANSINISRLLAQICYYFEAVAQLPQ<br>ETRNQLVVSVPSGNFGDLTAGLLAKSLGLPVKRFIAATNVNDTVPRF<br>LHDGQWSPKATQATLSNAMDVSQPNNWPRVEELFRRKIWQLKELGYA<br>AVDDETTQQTMRELKELGYTSEPHAAVAYRALRDQLNPGEYGLFLGT<br>AHPAKFKESVEAILGETLDLPKELAERADLPLLSHNLPADFAALRKL<br>MMNHQ* |
| ilvA$^{fbr}$<br>SEQ ID<br>NO: 37 | MSETYVSEKSPGVMASGAELIRAADIQTAQARISSVIAPTPLQYCPR<br>LSEETGAEIYLKREDLQDVRSYKIRGALNSGAQLTQEQRDAGIVAAS<br>AGNHAQGVAYVCKSLGVQGRIYVPVQTPKQKRDRIMVHGGEFVSLVV<br>TGNNFDEASAAAHEDAERTGATLIEPFDARNTVIGQGTVAAEILSQL<br>TSMGKSADHVMVPVGGGGLLAGVVSYMADMAPRTAIVGIEPAGAASM<br>QAALHNGGPITLETVDPFVDGAAVKRVGDLNYTIVEKNQGRVHMMSA<br>TEGAVCTEMLDLYQNEGIIAEPAGALSIAGLKEMSFAPGSAVVCIIS<br>GGNNDVLRYAEIAERSLVHRGLKHYFLVNFPQKPGQLRHFLEDILGP<br>DDDITLFEYLKRNNRETGTALVGIHLSEASGLDSLLERMEESAIDSR<br>RLEPGTPEYEYLT* |

TABLE 5-continued

| Polypeptide Sequences for Propionate Synthesis | |
|---|---|
| ace<br>SEQ ID<br>NO: 38 | MSERFPNDVDPIETRDWLQAIESVIREEGVERAQYLIDQLLAEARKG<br>GVNVAAGTGISNYINTIPVEEQPEYPGNLELERRIRSAIRWNAIMTV<br>LRASKKDLELGGHMASFQSSATIYDVCFNHFFRARNEQDGGDLVYFQ<br>GHISPGVYARAFLEGRLTQEQLDNFRQEVHGNGLSSYPHPKLMPEFW<br>QFPTVSMGLGPIGAIYQAKFLKYLEHRGLKDTSKQTVYAFLGDGEMD<br>EPESKGAITIATREKLDNLVFVINCNLQRLDGPVTGNGKIINELEGI<br>FEGAGWNVIKVMWGSRWDELLRKDTSGKLIQLMNETVDGDYQTFKSK<br>DGAYVREHFFGKYPETAALVADWTDEQIWALNRGGHDPKKIYAAFKK<br>AQETKGKATVILAHTIKGYGMGDAAEGKNIAHQVKKMNMDGVRHIRD<br>RFNVPVSDADIELPYITFPEGSEEHTYLHAQRQLHGYLPSRQPNF<br>TEKLELPSLQDFGALLEEQSKETSTTTAFVRALNVMLKNKSIKDRLV<br>PIIADEARTFGMEGLFRQIGIYSPNGQQYTPQDREQVAYYKEDEGQ<br>ILQEGINELGAGCSWLAAATSYSTNNLPMIPFYIYYSMFGFQRIGDL<br>CWAAGDQQARGFLIGGTSGRTTLNGEGLQHEDGHSHIQSLTIPNCIS<br>YDPAYAYEVAVIMHDGLERMYGEKQENVYYITTLNENYHMPAMPEG<br>AEEGIRKGIYLETIEGSGKVQLLGSGSILRHVREAAEILAKDYGV<br>GSDVYSVTSFTELARDGQDCERWNMLHPLETPRVPYTAQVMNDAPAV<br>ASTDYMKLFAEQVRTYVPADDYRVLGTDGFGRSDSRENLRHHFEVDA<br>SYVVVAALGELAKRGEIDKKVVADAIAKFNIDADKVNPRLA* |
| aceF<br>SEQ ID<br>NO: 39 | MAIEIKVPDIGADEVEITEILVKVGDVEAEQSLITVEGDKASMEVP<br>SPQAGIVREIVSVGDTQTGALIMIFDSADGAADAAPAQAEEKKEA<br>APAAAPAAAAAKDVNVPDIGSDEVEVTEILVKVGDKVEAEQSLITVE<br>GDKASMEVPAPFAGTVKEIKVNVGDVSTGSLIMVFEVAGEAGAAAP<br>AAKQEAAPAAAPAPAAGVKEVNVPDIGGDEVEVTEVMVKVGDKVAAE<br>QSLITVEGDKASMEVPAPFAGVVKELKVNVGDKVKTGSLIMIFEVEG<br>AAPAAAPAKQEAAAPAPAAKAEAPAAAPAAKAEGKSEFAENDAYVHA<br>TPLIRRLAREFGVNLAKVKGTGRKGRILREDVQAYVKEAIKRAEEAP<br>AATGGGIPGMLPWPKVDFSKFGEIEEVELGRIQKISGANLSRNWVMI<br>PHVTHFDKTDITELEAFRKQQNEEAAKRKLDVKITPVVFIMKAVAAA<br>LEQMPRFNSSLSEDGQRLTLKKYINIGVAVDTPNGLVVPVFKDVNKK<br>GIIELSRELMTISKKARDGKLTAGEMQGGCFTISSIGGLGTTHFAPI<br>VNAPEVAILGVSKSAMEPVWNGKEFVPRLMLPISLSFDHRVIDGADG<br>ARFITIINNTLSDIRRLVM* |
| Lpd<br>SEQ ID<br>NO: 40 | MSTEIKTQVVVLGAGPAGYSAAFRCADLGLETVIVERYNTLGGVCLN<br>VGCIPSKALLHVAKVIEEAKALAEHGIVFGEPKTDIDKIRTWKEKVI<br>NQLTGGLAGMAKGRKVKVVNGLGKFTGANTLEVEGENGKTVINFDNA<br>IIAAGSRPIQLPFIPHEDPRIWDSTDALELKEVPERLLVMGGGIIGL<br>EMGTVYHALGSQIDVVEMFDQVIPAADKDIVKVFTKRISKKFNLMLE<br>TKVTAVEAKEDGIYVTMEGKKAPAEPQRYDAVLVAIGRVPNGKNLDA<br>GKAGVEVDDRGFIRVDKQLRTNVPHIFAIGDIVGQPMLAHKGVHEGH<br>VAAEVIAGKKHYFDPKVIPSIAYTKPEVAWVGLTEKEAKEKGISYET<br>ATFPWAASGRAIASDCADGMTKLIFDKESHRVIGGAIVGTNGGELLG<br>EIGLAIEMGCDAEDIALTIHAHPTLHESVGLAAEVFEGSITDLPNPK<br>AKKK* |
| tesB<br>SEQ ID<br>NO: 41 | MSQALKNLLTLLNLEKIEEGLFRGQSEDLGLRQVFGGQVVGQALYAA<br>KETVPEERLVHSFHSYFLRPGDSKKPIIYDVETLRDGNSFSARRVAA<br>IQNGKPIFYMTASFQAPEAGFEHQKTMPSAPAPDGLPSETQIAQSLA<br>HLLPPVLKDKFICDRPLEVRPVEFHNPLKGHVAEPHRQVWIRANGSV<br>PDDLRVHQYLLGYASDLNFLPVALQPHGIGFLEPGIQIATIDHSMWF<br>HRPFNLNEWLLYSVESTSASSARGFVRGEFYTQDGVLVASTVQEGVM<br>RNHN* |
| acuI<br>SEQ ID<br>NO: 42 | MRAVLIEKSDDTQSVSVTELAEDQLPEGDVLVDVAYSTLNYKDALAI<br>TGKAPVVRRFPMVPGIDFTGTVAQSSHADFKPGDRVILNGWGVGEKH<br>WGGLAERARVRGDWLVPLPAPLDLRQAAMIGTAGYTAMLCVLALERH<br>GVVPGNGEIVVSGAAGGVGSVATTLLAAKGYEVAAVTGRASEAEYLR<br>GLGAASVIDRNELTGKVRPLGQERWAGGIDVAGSTVLANMLSMMKYR<br>GVVAACGLAAGMDLPASVAPFILRGMTLAGVDSVMCPKTDRLAAWAR<br>LASDLDPAKLEEMTTELPFSEVIETAPKFLDGTVRGRIVIPVTP* |
| Sbm<br>SEQ ID<br>NO: 43 | MSNVQEWQQLANKELSRREKTVDSLVHQTAEGIAIKPLYTEADLDNL<br>EVTGTLPGLPPYVRGPRATMYTAQPWTIRQYAGFSTAKESNAFYRRN<br>LAAGQKGLSVAFDLATHRGYDSDNPRVAGDVGKAGVAIDTVEDMKVL<br>FDQIPLDKMSVSMTMNGAVLPVLAFYIVAAEEQGVTPDKLTGTIQND<br>ILKEYLCRNTYIYPPKPSMRIIADIIAWCSGNMPRFNTISISGYHMG<br>EAGANCVQQVAFTLADGIEYIKAAISAGLKIDDFAPRLSFFFGIGMD<br>LFMNVAMLRAARYLWSEAVSGFGAQDPKSLALRTHCQTSGWSLTEQD<br>PYNNVIRTTIEALAATLGGTQSLHTNAFDEALGLPTDFSARIARNTQ<br>IIIQEESELCRTVDPLAGSYYIESLTDQIVKQARAIIQQIDEAGGMA<br>KAIEAGLPKRMIEEASAREQSLIDQGKRVIVGVNKYKLDHEDETDVL<br>EIDNVMVRNEQIASLERIRATRDDAAVTAALNALTHAAQHNENLLAA<br>AVNAARVRATLGEISDALEVAFDRYLVPSQVTGVIAQSYHQSEKSA<br>SEFDAIVAQTEQFLADNGRRPRILIAKMGQDGHDRGAKVIASAYSDL |

TABLE 5-continued

Polypeptide Sequences for Propionate Synthesis

| | |
|---|---|
| | GFDVDLSPMFSTPEEIARLAVENDVHVVGASSLAAGHKTLIPELVEA<br>LKKWGREDICVVAGGVIPPQDYAFLQERGVAAIYGPGTPMLDSVRDV<br>LNLISQHHD* |
| ygfD<br>SEQ ID<br>NO: 44 | MINEATLAESIRRLRQGERATLAQAMTLVESRHPRHQALSTQLLDAI<br>MPYCGNTLRLGVTGTPGAGKSTFLEAFGMLLIREGLKVAVIAVDPSS<br>PVTGGSILGDKTRMNDLARAEAAFIRPVPSSGHLGGASQRARELMLL<br>CEAAGYDVVIVETVGVGQSETEVARMVDCFISLQIAGGGDDLQGIKK<br>GLMEVADLIVINKDDGDNHTNVAIARHMYESALHILRRKYDEWQPRV<br>LTCSALEKRGIDEIWHAIIDFKTALTASGRLQQVRQQQSVEWLRKQT<br>EEEVLNHLFANEDFDRYYRQTLLAVKNNTLSPRTGLRQLSEFIQTQY<br>FD* |
| ygfG<br>SEQ ID<br>NO: 45 | MSYQYVNVVTINKVAVIEFNYGRKLNALSKVFIDDLMQALSDLNRPE<br>IRCIILRAPSGSKVFSAGHDIHELPSGGRDPLSYDDPLRQITRMIQK<br>FPKPIISMVEGSVWGGAFEMIMSSDLIIAASTSTFSMTPVNLGVPYN<br>LVGIHNLTRDAGFHIVKELIFTASPITAQRALAVGILNHWEVEELE<br>DFTLQMAHHISELAIAVIKEELRVLGEAHTMNSDEFERIQGMRR<br>AVYDSEDYQEGMNAFLEKRKPNFVGH* |
| ygfH<br>SEQ ID<br>NO: 46 | METQWTRMTANEAAEIIQHNDMVAFSGFTPAGSPKALPTAIAPRANE<br>QHEAKKPYQIRLLTGASISAAADDVLSDADAVSWRAPYQTSSGLRKK<br>INQGAVSFVDLHLSEVAQMVNYGFFGDIDVAVIEASALAPDGRVWLT<br>SGIGNAPTWLLRAKKVIIELNHYHDPRVAELADIVIPGAPPRRNSVS<br>IFHAMDRVGTRYVQIDPKKIVAVVETNLPDAGNMLDKQNPMCQQIAD<br>NVVTFLLQEMAHGRIPPEFLPLQSGVGNINNAVMARLGENPVIPPFM<br>MYSEVLQESVVHLLETGKISGASASSLTISADSLRKIYDNMDYFASR<br>IVLRPQEISNNPEIIRRLGVIALNVGLEFDIYGHANSTHVAGVDLMN<br>GIGGSGDFERNAYLSIFMAPSIAKEGKISTVVPMCSHVDHSEHSVKV<br>IITEQGIADLRGLSPLQRARTIIDNAHPMYRDYLHRYLENAPGGHI<br>HHDLSHVFDLHRNLIATGSMLG* |
| mutA<br>SEQ ID<br>NO: 47 | MSSTDQGTNPADTDDLTPTTLSLAGDFPKATEEQWEREVEKVFNRGRP<br>PEKQLTFAECLKRLTVHTVDGIDIVPMYRPKDAPKKLGYPGVTPFTRG<br>TTVRNGDMDAWDVRALHEDPDEKFTRKAILEDLERGVTSLLLRVDPDA<br>IAPEHLDEVLSDVLLEMTKVEVFSRYDQGAAAEALMGVYERSDKPAKD<br>LALNLGLDPIGFAALQGTEPDLTVLGDWVRRLAKFSPDSRAVTIDANV<br>YHNAGAGDVAELAWALATGAEYVRALVEQGFNATEAFDTINFRVTATH<br>DQFLTIARLRALREAWARIGEVEGVDEDKRGARQNAITSWRELTREDP<br>YVNILRGSIATFSASVGGAESITTLPFTQALGLPEDDFPLRIARNTGI<br>VLAEEVNIGRVNDPAGGSYYVESLTRTLADAAWKEFQEVEKLGGMSKA<br>VMTEHVTKVLDACNAERAKRLANRKQPITAVSEFPMIGARSIETKPFP<br>TAPARKGLAWHRDSEVFEQLMDRSTSVSERPKVFLACLGTRRDFGGRE<br>GFSSPVWHIAGIDTPQVEGGTTAEIVEAFKKSGAQVADLCSSAKIYAQ<br>QGLEVAKALKAAGAKALYLSGAFKEFGDDAAEAEKLIDGRLYMGMDVV<br>DTLSSTLDILGVAK |
| mmtB<br>SEQ ID<br>NO: 48 | VSTLPRFDSVDLGNAPVPADAAQRFEELAAKAGTEEAWETAEQIPVGT<br>LFNEDVYKDMDWLDTYAGIPPFVHGPYATMYAFRPWTIRQYAGFSTAK<br>ESNAFYRRNLAAGQKGLSVAFDLPTHRGYDSDNPRVAGDVGMAGVAID<br>SIYDMRELFAGIPLDQMSVSMTMNGAVLPILALYVVTAEEQGVKPEQL<br>AGTIQNDILKEFMVRNTYIYPPQPSMRIISEIFAYTSANMPKWNSISI<br>SGYHMQEAGATADIEMAYTLADGVDYIRAGESVGLNVDQFAPRLSFFW<br>GIGMNFFMEVAKLRAARMLWAKLVHQFGPKNPKSMSLRTHSQTSGWSL<br>TAQDVYNNVVRTCIEAMAATQGHTQSLHTNSLDEAIALPTDFSARIAR<br>NTQLFLQQESGTTRVIDPWSGSAYVEELTWDLARKAWGHIQEVEKVGG<br>MAKAIEKGIPKMRIEEAAARTQARIDSGRQPLIGVNKYRLEHEPPLDV<br>LKVDNSTVLAEQKAKLVKLRAERDPEKVKAALDKITWAAANPDDKDPD<br>RNLLKLCIDAGRAMATVGEMSDALEKVFGRYTAQIRTISGVYSKEVKN<br>TPEVEEARELVEEFEQAEGRRPRILLAKMGQDGHDRGQKVIATAYADL<br>GFDVDVGPLFQTPEETARQAVEADVHVVGVSSLAGGHLTLVPALRKEL<br>DKLGRPDILITVGGVIPEQDFDELRKDGAVEIYTPGTVIPESAISLVK<br>KLRASLDA |
| GI: 18042134<br>SEQ ID<br>NO: 49 | MSNEDLFICIDHVAYACPDADEASKYYQETFGWHELHREENPEQGVVE<br>IMMAPAAKLTEHMTQVQVMAPLNDESTVAKWLAKHNGRAGLHHMAWRV<br>DDIDAVSATLRERGVQLLYDEPKLGTGGNRINFMHPKSGKGVLIELTQ<br>YPKN |
| mmdA<br>SEQ ID<br>NO: 50 | MAENNNLKLASTMEGRVEQLAEQRQVIEAGGGERRVEKQHSQGKQTAR<br>ERLNNLLDPHSFDEVGAFRKHRTTLFGMDKAVVPADGVVTGRGTILGR<br>PVHAASQDFTVMGGSAGETQSTKVVETMEQALLTGTPFLFFYDSGGAR<br>IQEGIDSLSGYGKMFFANVKLSGVVPQIAIIAGPCAGGASYSPALTDF<br>IIMTKKAHMFITGPQVIKSVTGEDVTADELGGAEAHMAISGNIHFVAE<br>DDDAAELIAKKLLSFLPQNNTEEASFVNPNNDVSPNTELRDIVPIDGK<br>KGYDVRDVIAKIVDWGDYLEVKAGYATNLVTAFARVNGRSVGIVANQP<br>SVMSGCLDINASDKAAEFVNFCDSFNIPLVQLVDVPGFLPGVQQEYGG<br>IIRHGAKMLYAYSEATVPKITVVLRKAYGGSYLAMCNRDLGADAVYAW |

TABLE 5-continued

Polypeptide Sequences for Propionate Synthesis

|  |  |
|---|---|
|  | PSAEIAVMGAEGAANVIFRKEIKAADDPDAMRAEKIEEYQNAFNTPYV<br>AAARGQVDDVIDPADTRRKIASALEMYATKRQTRPAKKHGNFPC |
| PFREUD_18870<br>SEQ ID<br>NO: 51 | MSPREIEVSEPREVGITELVLRDAHQSLMATRMAMEDMVGACADIDAA<br>GYWSVECWGGATYDSCIRFLNEDPWERLRTFRKLMPNSRLQMLLRGQN<br>LLGYRHYNDEVVDRFVDKSAENGMDVFRVFDAMNDPRNMAHAMAAVKK<br>AGKHAQGTICYTISPVHTVEGYVKLAGQLLDMGADSIALKDMAALLKP<br>QPAYDIIKAIKDTYGQKTQINLHCHSTTGVTEVSLMKAIEAGVDVVDT<br>AISSMSLGPGHNPTESVAEMLEGTGYTTNLDYDRLHKIRDHFKAIRPK<br>YKKFESKTLVDTSIFKSQIPGGMLSNMESQLRAQGAEDKMDEVMAEVP<br>RVRKAAGFPPLVTPSSQIVGTQAVFNVMMGEYKRMTGEFADIMLGYYG<br>ASPADRDPKVVKLAEEQSGKKPITQRPADLLPPEWEEQSKEAAALKGF<br>NGTDEDVLTYALFPQVAPVFFEHRAEGPHSVALTDAQLKAEAEGDEKS<br>LAVAGPVTYNVNVGGTVREVTVQQA |
| Bccp<br>SEQ ID<br>NO: 52 | MKLKVTVNGTAYDVDVDVDKSHENPMGTILFGGGTGGAPAPRAAGGAG<br>AGKAGEGEIPAPLAGTVSKILVKEGDTVKAGQTVLVLEAMKMETEINA<br>PTDGKVEKVLVKERDAVQGGQGLIKIG |

In some embodiments, the genetically engineered bacteria encode one or more polypeptide sequences of Table 5 (SEQ ID NO: 27-SEQ ID NO: 52) or a functional fragment or variant thereof. In some embodiments, genetically engineered bacteria comprise a polypeptide sequence that is at least about 80%, at least about 85%, at least about 90%, at least about 95%, or at least about 99% homologous to the polypeptide sequence of one or more polypeptide sequence of Table 5 (SEQ ID NO: 27-SEQ ID NO: 52) or a functional fragment thereof.

In one embodiment, the bacterial cell comprises a heterologous propionate gene cassette. In some embodiments, the disclosure provides a bacterial cell that comprises a heterologous propionate gene cassette operably linked to a first promoter. In one embodiment, the first promoter is an inducible promoter. In one embodiment, the bacterial cell comprises a propionate gene cassette from a different organism, e.g., a different species of bacteria. In another embodiment, the bacterial cell comprises more than one copy of a native gene encoding a propionate gene cassette. In yet another embodiment, the bacterial cell comprises at least one native gene encoding a propionate gene cassette, as well as at least one copy of a propionate gene cassette from a different organism, e.g., a different species of bacteria. In one embodiment, the bacterial cell comprises at least one, two, three, four, five, or six copies of a gene encoding a propionate gene cassette. In one embodiment, the bacterial cell comprises multiple copies of a gene or genes encoding a propionate gene cassette.

Multiple distinct propionate gene cassettes are known in the art. In some embodiments, a propionate gene cassette is encoded by a gene cassette derived from a bacterial species. In some embodiments, a propionate gene cassette is encoded by a gene cassette derived from a non-bacterial species. In some embodiments, a propionate gene cassette is encoded by a gene derived from a eukaryotic species, e.g., a fungi. In one embodiment, the gene encoding the propionate gene cassette is derived from an organism of the genus or species that includes, but is not limited to, *Clostridium propionicum*, *Megasphaera elsdenii*, or *Prevotella ruminicola*.

In one embodiment, the propionate gene cassette has been codon-optimized for use in the engineered bacterial cell. In one embodiment, the propionate gene cassette has been codon-optimized for use in *Escherichia coli*. In another embodiment, the propionate gene cassette has been codon-optimized for use in *Lactococcus*. When the propionate gene cassette is expressed in the engineered bacterial cells, the bacterial cells produce more propionate than unmodified bacteria of the same bacterial subtype under the same conditions (e.g., culture or environmental conditions). Thus, the genetically engineered bacteria comprising a heterologous propionate gene cassette may be used to generate propionate to treat liver disease, such as nonalcoholic steatohepatitis (NASH).

The present disclosure further comprises genes encoding functional fragments of propionate biosynthesis enzymes or functional variants of a propionate biosynthesis enzyme. As used herein, the term "functional fragment thereof" or "functional variant thereof" relates to an element having qualitative biological activity in common with the wild-type enzyme from which the fragment or variant was derived. For example, a functional fragment or a functional variant of a mutated propionate biosynthesis enzyme is one which retains essentially the same ability to synthesize propionate as the propionate biosynthesis enzyme from which the functional fragment or functional variant was derived. For example a polypeptide having propionate biosynthesis enzyme activity may be truncated at the N-terminus or C-terminus, and the retention of propionate biosynthesis enzyme activity assessed using assays known to those of skill in the art, including the exemplary assays provided herein. In one embodiment, the engineered bacterial cell comprises a heterologous gene encoding a propionate biosynthesis enzyme functional variant. In another embodiment, the engineered bacterial cell comprises a heterologous gene encoding a propionate biosynthesis enzyme functional fragment.

As used herein, the term "percent (%) sequence identity" or "percent (%) identity," also including "homology," is defined as the percentage of amino acid residues or nucleotides in a candidate sequence that are identical with the amino acid residues or nucleotides in the reference sequences after aligning the sequences and introducing gaps, if necessary, to achieve the maximum percent sequence identity, and not considering any conservative substitutions as part of the sequence identity. Optimal alignment of the sequences for comparison may be produced, besides manually, by means of the local homology algorithm of Smith and Waterman, 1981, Ads App. Math. 2, 482, by means of the local homology algorithm of Neddleman and Wunsch, 1970, J. Mol. Biol. 48, 443, by means of the similarity search method of Pearson and Lipman, 1988, Proc. Natl. Acad. Sci.

USA 85, 2444, or by means of computer programs which use these algorithms (GAP, BESTFIT, FASTA, BLAST P, BLAST N and TFASTA in Wisconsin Genetics Software Package, Genetics Computer Group, 575 Science Drive, Madison, Wis.).

The present disclosure encompasses propionate biosynthesis enzymes comprising amino acids in its sequence that are substantially the same as an amino acid sequence described herein. Amino acid sequences that are substantially the same as the sequences described herein include sequences comprising conservative amino acid substitutions, as well as amino acid deletions and/or insertions. A conservative amino acid substitution refers to the replacement of a first amino acid by a second amino acid that has chemical and/or physical properties (e.g., charge, structure, polarity, hydrophobicity/hydrophilicity) that are similar to those of the first amino acid. Conservative substitutions include replacement of one amino acid by another within the following groups: lysine (K), arginine (R) and histidine (H); aspartate (D) and glutamate (E); asparagine (N), glutamine (Q), serine (S), threonine (T), tyrosine (Y), K, R, H, D and E; alanine (A), valine (V), leucine (L), isoleucine (I), proline (P), phenylalanine (F), tryptophan (W), methionine (M), cysteine (C) and glycine (G); F, W and Y; C, S and T. Similarly contemplated is replacing a basic amino acid with another basic amino acid (e.g., replacement among Lys, Arg, His), replacing an acidic amino acid with another acidic amino acid (e.g., replacement among Asp and Glu), replacing a neutral amino acid with another neutral amino acid (e.g., replacement among Ala, Gly, Ser, Met, Thr, Leu, Ile, Asn, Gln, Phe, Cys, Pro, Trp, Tyr, Val).

In some embodiments, a propionate biosynthesis enzyme is mutagenized; mutants exhibiting increased activity are selected; and the mutagenized gene encoding the propionate biosynthesis enzyme is isolated and inserted into the bacterial cell of the disclosure. The gene comprising the modifications described herein may be present on a plasmid or chromosome.

In one embodiment, the propionate biosynthesis gene cassette is from *Clostridium* spp. In one embodiment, the *Clostridium* spp. is *Clostridium propionicum*. In another embodiment, the propionate biosynthesis gene cassette is from a *Megasphaera* spp. In one embodiment, the *Megasphaera* spp. is *Megasphaera elsdenii*. In another embodiment, the propionate biosynthesis gene cassette is from *Prevotella* spp. In one embodiment, the *Prevotella* spp. is *Prevotella ruminicola*. Other propionate biosynthesis gene cassettes are well-known to one of ordinary skill in the art.

In some embodiments, the genetically engineered bacteria comprise the genes pet, lcd, and acr from *Clostridium propionicum*. In some embodiments, the genetically engineered bacteria comprise acrylate pathway genes for propionate biosynthesis, e.g., pet, lcdA, lcdB, lcdC, etfA, acrB, and acrC. In alternate embodiments, the genetically engineered bacteria comprise pyruvate pathway genes for propionate biosynthesis, e.g., thrA$^{fbr}$, thrB, thrC, ilvA$^{fbr}$, aceE, aceF, and lpd, and optionally further comprise tesB. The genes may be codon-optimized, and translational and transcriptional elements may be added.

In one embodiment, the pct gene has at least about 80% identity with SEQ ID NO: 1. In another embodiment, the pct gene has at least about 85% identity with SEQ ID NO: 1. In one embodiment, the pct gene has at least about 90% identity with SEQ ID NO: 1. In one embodiment, the pct gene has at least about 95% identity with SEQ ID NO: 1. In another embodiment, the pct gene has at least about 96%, 97%, 98%, or 99% identity with SEQ ID NO: 1. Accordingly, in one embodiment, the pct gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 1. In another embodiment, the pct gene comprises the sequence of SEQ ID NO: 1. In yet another embodiment the pct gene consists of the sequence of SEQ ID NO: 1.

In one embodiment, the lcdA gene has at least about 80% identity with SEQ ID NO: 2. In another embodiment, the lcdA gene has at least about 85% identity with SEQ ID NO: 2. In one embodiment, the lcdA gene has at least about 90% identity with SEQ ID NO: 2. In one embodiment, the lcdA gene has at least about 95% identity with SEQ ID NO: 2. In another embodiment, the lcdA gene has at least about 96%, 97%, 98%, or 99% identity with SEQ ID NO: 2. Accordingly, in one embodiment, the lcdA gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 2. In another embodiment, the lcdA gene comprises the sequence of SEQ ID NO: 2. In yet another embodiment the lcdA gene consists of the sequence of SEQ ID NO: 2.

In one embodiment, the lcdB gene has at least about 80% identity with SEQ ID NO: 3. In another embodiment, the lcdB gene has at least about 85% identity with SEQ ID NO: 3. In one embodiment, the lcdB gene has at least about 90% identity with SEQ ID NO: 3. In one embodiment, the lcdB gene has at least about 95% identity with SEQ ID NO: 3. In another embodiment, the lcdB gene has at least about 96%, 97%, 98%, or 99% identity with SEQ ID NO: 3. Accordingly, in one embodiment, the lcdB gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 3. In another embodiment, the lcdB gene comprises the sequence of SEQ ID NO: 3. In yet another embodiment the lcdB gene consists of the sequence of SEQ ID NO: 3.

In one embodiment, the lcdC gene has at least about 80% identity with SEQ ID NO: 4. In another embodiment, the lcdC gene has at least about 85% identity with SEQ ID NO: 4. In one embodiment, the lcdC gene has at least about 90% identity with SEQ ID NO: 4. In one embodiment, the lcdC gene has at least about 95% identity with SEQ ID NO: 4. In another embodiment, the lcdC gene has at least about 96%, 97%, 98%, or 99% identity with SEQ ID NO: 4. Accordingly, in one embodiment, the lcdA gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 4. In another embodiment, the lcdC gene comprises the sequence of SEQ ID NO: 4. In yet another embodiment the lcdC gene consists of the sequence of SEQ ID NO: 4.

In one embodiment, the etfA gene has at least about 80% identity with SEQ ID NO: 5. In another embodiment, the etfA gene has at least about 85% identity with SEQ ID NO: 5. In one embodiment, the etfA gene has at least about 90% identity with SEQ ID NO: 5. In one embodiment, the etfA gene has at least about 95% identity with SEQ ID NO: 5. In another embodiment, the etfA gene has at least about 96%, 97%, 98%, or 99% identity with SEQ ID NO: 5. Accordingly, in one embodiment, the etfA gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 5. In another embodiment, the etfA gene comprises the sequence of SEQ ID NO: 5. In yet another embodiment the etfA gene consists of the sequence of SEQ ID NO: 5.

In one embodiment, the acrB gene has at least about 80% identity with SEQ ID NO: 6. In another embodiment, the acrB gene has at least about 85% identity with SEQ ID NO: 6. In one embodiment, the acrB gene has at least about 90% identity with SEQ ID NO: 6. In one embodiment, the acrB gene has at least about 95% identity with SEQ ID NO: 6. In another embodiment, the acrB gene has at least about 96%, 97%, 98%, or 99% identity with SEQ ID NO: 6. Accordingly, in one embodiment, the acrB gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 6. In another embodiment, the acrB gene comprises the sequence of SEQ ID NO: 6. In yet another embodiment the acrB gene consists of the sequence of SEQ ID NO: 6.

In one embodiment, the acrC gene has at least about 80% identity with SEQ ID NO: 7. In another embodiment, the acrC gene has at least about 85% identity with SEQ ID NO: 7. In one embodiment, the acrC gene has at least about 90% identity with SEQ ID NO: 7. In one embodiment, the acrC gene has at least about 95% identity with SEQ ID NO: 7. In another embodiment, the acrC gene has at least about 96%, 97%, 98%, or 99% identity with SEQ ID NO: 7. Accordingly, in one embodiment, the acrC gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 7. In another embodiment, the acrC gene comprises the sequence of SEQ ID NO: 7. In yet another embodiment the acrC gene consists of the sequence of SEQ ID NO: 7.

In one embodiment, the thrA$^{fbr}$ gene has at least about 80% identity with SEQ ID NO: 8. In another embodiment, the thrA$^{fbr}$ gene has at least about 85% identity with SEQ ID NO: 8. In one embodiment, the thrA$^{fbr}$ gene has at least about 90% identity with SEQ ID NO: 8. In one embodiment, the thrA$^{fbr}$ gene has at least about 95% identity with SEQ ID NO: 8. In another embodiment, the thrA$^{fbr}$ gene has at least about 96%, 97%, 98%, or 99% identity with SEQ ID NO: 8. Accordingly, in one embodiment, the thrA$^{fbr}$ gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 8. In another embodiment, the thrA$^{fbr}$ gene comprises the sequence of SEQ ID NO: 8. In yet another embodiment the thrA$^{fbr}$ gene consists of the sequence of SEQ ID NO: 8.

In one embodiment, the thrB gene has at least about 80% identity with SEQ ID NO: 9. In another embodiment, the thrB gene has at least about 85% identity with SEQ ID NO: 9. In one embodiment, the thrB gene has at least about 90% identity with SEQ ID NO: 9. In one embodiment, the thrB gene has at least about 95% identity with SEQ ID NO: 9. In another embodiment, the thrB gene has at least about 96%, 97%, 98%, or 99% identity with SEQ ID NO: 9. Accordingly, in one embodiment, the thrB gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 9. In another embodiment, the thrB gene comprises the sequence of SEQ ID NO: 9. In yet another embodiment the thrB gene consists of the sequence of SEQ ID NO: 9.

In one embodiment, the thrC gene has at least about 80% identity with SEQ ID NO: 10. In another embodiment, the thrC gene has at least about 85% identity with SEQ ID NO: 10. In one embodiment, the thrC gene has at least about 90% identity with SEQ ID NO: 10. In one embodiment, the thrC gene has at least about 95% identity with SEQ ID NO: 10. In another embodiment, the thrC gene has at least about 96%, 97%, 98%, or 99% identity with SEQ ID NO: 10. Accordingly, in one embodiment, the thrC gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 10. In another embodiment, the thrC gene comprises the sequence of SEQ ID NO: 10. In yet another embodiment the thrC gene consists of the sequence of SEQ ID NO: 10.

In one embodiment, the ilvA$^{fbr}$ gene has at least about 80% identity with SEQ ID NO: 11. In another embodiment, the ilvA$^{fbr}$ gene has at least about 85% identity with SEQ ID NO: 11. In one embodiment, the ilvA gene has at least about 90% identity with SEQ ID NO: 11. In one embodiment, the ilvA gene has at least about 95% identity with SEQ ID NO: 11. In another embodiment, the ilvA gene has at least about 96%, 97%, 98%, or 99% identity with SEQ ID NO: 11. Accordingly, in one embodiment, the ilvA$^{fbr}$ gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 11. In another embodiment, the ilvA$^{fbr}$ gene comprises the sequence of SEQ ID NO: 11. In yet another embodiment the ilvA gene consists of the sequence of SEQ ID NO: 11.

In one embodiment, the aceE gene has at least about 80% identity with SEQ ID NO: 12. In another embodiment, the aceE gene has at least about 85% identity with SEQ ID NO: 12. In one embodiment, the aceE gene has at least about 90% identity with SEQ ID NO: 12. In one embodiment, the aceE gene has at least about 95% identity with SEQ ID NO: 12. In another embodiment, the aceE gene has at least about 96%, 97%, 98%, or 99% identity with SEQ ID NO: 12. Accordingly, in one embodiment, the aceE gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 12. In another embodiment, the aceE gene comprises the sequence of SEQ ID NO: 12. In yet another embodiment the aceE gene consists of the sequence of SEQ ID NO: 12.

In one embodiment, the aceF gene has at least about 80% identity with SEQ ID NO: 13. In another embodiment, the aceF gene has at least about 85% identity with SEQ ID NO: 13. In one embodiment, the aceF gene has at least about 90% identity with SEQ ID NO: 13. In one embodiment, the aceF gene has at least about 95% identity with SEQ ID NO: 13. In another embodiment, the aceF gene has at least about 96%, 97%, 98%, or 99% identity with SEQ ID NO: 13. Accordingly, in one embodiment, the aceF gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 13. In another embodiment, the aceF gene comprises the sequence of SEQ ID NO: 13. In yet another embodiment the aceF gene consists of the sequence of SEQ ID NO: 13.

In one embodiment, the lpd gene has at least about 80% identity with SEQ ID NO: 14. In another embodiment, the lpd gene has at least about 85% identity with SEQ ID NO: 14. In one embodiment, the lpd gene has at least about 90% identity with SEQ ID NO: 14. In one embodiment, the lpd gene has at least about 95% identity with SEQ ID NO: 14. In another embodiment, the lpd gene has at least about 96%, 97%, 98%, or 99% identity with SEQ ID NO: 14. Accordingly, in one embodiment, the lpd gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 14. In another embodiment, the lpd gene comprises the sequence of SEQ ID NO: 14. In yet another embodiment the lpd gene consists of the sequence of SEQ ID NO: 14.

In one embodiment, the tesB gene has at least about 80% identity with SEQ ID NO: 15. In another embodiment, the tesB gene has at least about 85% identity with SEQ ID NO: 15. In one embodiment, the tesB gene has at least about 90% identity with SEQ ID NO: 15. In one embodiment, the tesB gene has at least about 95% identity with SEQ ID NO: 15. In another embodiment, the tesB gene has at least about 96%, 97%, 98%, or 99% identity with SEQ ID NO: 15. Accordingly, in one embodiment, the tesB gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 15. In another embodiment, the tesB gene comprises the sequence of SEQ ID NO: 15. In yet another embodiment the tesB gene consists of the sequence of SEQ ID NO: 15.

In one embodiment, the acuI gene has at least about 80% identity with SEQ ID NO: 16. In another embodiment, the acuI gene has at least about 85% identity with SEQ ID NO: 16. In one embodiment, the acuI gene has at least about 90% identity with SEQ ID NO: 16. In one embodiment, the acuI gene has at least about 95% identity with SEQ ID NO: 16. In another embodiment, the acuI gene has at least about 96%, 97%, 98%, or 99% identity with SEQ ID NO: 16. Accordingly, in one embodiment, the acuI gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 16. In another embodiment, the acuI gene comprises the sequence of SEQ ID NO: 16. In yet another embodiment the acuI gene consists of the sequence of SEQ ID NO: 16.

In one embodiment, the sbm gene has at least about 80% identity with SEQ ID NO: 17. In another embodiment, the sbm gene has at least about 85% identity with SEQ ID NO: 17. In one embodiment, the sbm gene has at least about 90% identity with SEQ ID NO: 17. In one embodiment, the sbm gene has at least about 95% identity with SEQ ID NO: 17. In another embodiment, the sbm gene has at least about 96%, 97%, 98%, or 99% identity with SEQ ID NO: 17.0. Accordingly, in one embodiment, the sbm gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 17. In another embodiment, the sbm gene comprises the sequence of SEQ ID NO: 17. In yet another embodiment the sbm gene consists of the sequence of SEQ ID NO: 17.

In one embodiment, the ygfD gene has at least about 80% identity with SEQ ID NO: 18. In another embodiment, the ygfD gene has at least about 85% identity with SEQ ID NO: 18. In one embodiment, the ygfD gene has at least about 90% identity with SEQ ID NO: 18. In one embodiment, the ygfD gene has at least about 95% identity with SEQ ID NO: 18. In another embodiment, the ygfD gene has at least about 96%, 97%, 98%, or 99% identity with SEQ ID NO: 18. Accordingly, in one embodiment, the ygfD gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 18. In another embodiment, the ygfD gene comprises the sequence of SEQ ID NO: 18. In yet another embodiment the ygfD gene consists of the sequence of SEQ ID NO: 18.

In one embodiment, the ygfG gene has at least about 80% identity with SEQ ID NO: 19. In another embodiment, the ygfG gene has at least about 85% identity with SEQ ID NO: 19. In one embodiment, the ygfG gene has at least about 90% identity with SEQ ID NO: 19. In one embodiment, the ygfG gene has at least about 95% identity with SEQ ID NO: 19. In another embodiment, the ygfG gene has at least about 96%, 97%, 98%, or 99% identity with SEQ ID NO: 19. Accordingly, in one embodiment, the ygfG gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 19. In another embodiment, the ygfG gene comprises the sequence of SEQ ID NO: 19. In yet another embodiment the ygfG gene consists of the sequence of SEQ ID NO: 19.

In one embodiment, the ygfH gene has at least about 80% identity with SEQ ID NO: 20. In another embodiment, the ygfH gene has at least about 85% identity with SEQ ID NO: 20. In one embodiment, the ygfH gene has at least about 90% identity with SEQ ID NO: 20. In one embodiment, the ygfH gene has at least about 95% identity with SEQ ID NO: 20. In another embodiment, the ygfH gene has at least about 96%, 97%, 98%, or 99% identity with SEQ ID NO: 20. Accordingly, in one embodiment, the ygfH gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 20. In another embodiment, the ygfH gene comprises the sequence of SEQ ID NO: 20. In yet another embodiment the ygfH gene consists of the sequence of SEQ ID NO: 20.

In one embodiment, one or more polypeptides encoded by the propionate circuits and expressed by the genetically engineered bacteria have at least about 80% identity with one or more of SEQ ID NO: 27 through SEQ ID NO: 52. In another embodiment, one or more polypeptides encoded by the propionate circuits and expressed by the genetically engineered bacteria have at least about 85% identity with one or more of SEQ ID NO: 27 through SEQ ID NO: 52. In one embodiment, one or more polypeptides encoded by the propionate circuits and expressed by the genetically engineered bacteria have at least about 90% identity with one or more of SEQ ID NO: 27 through SEQ ID NO: 52. In one embodiment, one or more polypeptides encoded by the propionate circuits and expressed by the genetically engineered bacteria have at least about 95% identity with one or more of SEQ ID NO: 27 through SEQ ID NO: 52. In another embodiment, one or more polypeptides encoded by the propionate circuits and expressed by the genetically engineered bacteria have at least about 96%, 97%, 98%, or 99% identity with one or more of SEQ ID NO: 27 through SEQ ID NO: 52. Accordingly, in one embodiment, one or more polypeptides encoded by the propionate circuits and expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 27 through SEQ ID NO: 52. In another embodiment, one or more polypeptides encoded by the propionate circuits and expressed by the genetically engineered bacteria one or more polypeptides encoded by the propionate circuits and expressed by the genetically engineered bacteria comprise the sequence of one or more of SEQ ID NO: 27 through SEQ ID NO: 52. In yet another embodiment one or more polypeptides encoded by the propionate circuits and expressed by the genetically engineered bacteria consist of or more of SEQ ID NO: 27 through SEQ ID NO: 52.

In some embodiments, one or more of the propionate biosynthesis genes is a synthetic propionate biosynthesis gene. In some embodiments, one or more of the propionate biosynthesis genes is an *E. coli* propionate biosynthesis gene. In some embodiments, one or more of the propionate biosynthesis genes is a *C. glutamicum* propionate biosynthesis gene. In some embodiments, one or more of the propionate biosynthesis genes is a *C. propionicum* propionate biosynthesis gene. In some embodiments, one or more of the propionate biosynthesis genes is a *R. sphaeroides* propionate biosynthesis gene. The propionate gene cassette may comprise genes for the aerobic biosynthesis of propionate and/or genes for the anaerobic or microaerobic biosynthesis of propionate.

In some embodiments, the genetically engineered bacteria comprise a combination of propionate biosynthesis genes from different species, strains, and/or substrains of bacteria, and are capable of producing propionate. In some embodiments, one or more of the propionate biosynthesis genes is functionally replaced, modified, and/or mutated in order to enhance stability and/or increase propionate production. In some embodiments, the local production of propionate reduces food intake and ameliorates metabolic disease (Lin et al., 2012). In some embodiments, the genetically engineered bacteria are capable of expressing the propionate biosynthesis cassette and producing propionate in low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose.

In one embodiment, the propionate gene cassette is directly operably linked to a first promoter. In another embodiment, the propionate gene cassette is indirectly operably linked to a first promoter. In one embodiment, the promoter is not operably linked with the propionate gene cassette in nature.

In some embodiments, the propionate gene cassette is expressed under the control of a constitutive promoter. In another embodiment, the propionate gene cassette is expressed under the control of an inducible promoter. In some embodiments, the propionate gene cassette is expressed under the control of a promoter that is directly or indirectly induced by exogenous environmental conditions. In one embodiment, the propionate gene cassette is expressed under the control of a promoter that is directly or indirectly induced by low-oxygen or anaerobic conditions, wherein expression of the propionate gene cassette is activated under low-oxygen or anaerobic environments, such as the environment of the mammalian gut. Inducible promoters are described in more detail infra.

The propionate gene cassette may be present on a plasmid or chromosome in the bacterial cell. In one embodiment, the propionate gene cassette is located on a plasmid in the bacterial cell. In another embodiment, the propionate gene cassette is located in the chromosome of the bacterial cell. In yet another embodiment, a native copy of the propionate gene cassette is located in the chromosome of the bacterial cell, and a propionate gene cassette from a different species of bacteria is located on a plasmid in the bacterial cell. In yet another embodiment, a native copy of the propionate gene cassette is located on a plasmid in the bacterial cell, and a propionate gene cassette from a different species of bacteria is located on a plasmid in the bacterial cell. In yet another embodiment, a native copy of the propionate gene cassette is located in the chromosome of the bacterial cell, and a propionate gene cassette from a different species of bacteria is located in the chromosome of the bacterial cell.

In some embodiments, the propionate gene cassette is expressed on a low-copy plasmid. In some embodiments, the propionate gene cassette is expressed on a high-copy plasmid. In some embodiments, the high-copy plasmid may be useful for increasing expression of propionate.

Butyrate

In some embodiments, the genetically engineered bacteria of the invention comprise a butyrogenic gene cassette and are capable of producing butyrate under particular exogenous environmental conditions. The genetically engineered bacteria may include any suitable set of butyrogenic genes (see, e.g., Table 3). Unmodified bacteria comprising butyrate biosynthesis genes are known and include, but are not limited to, *Peptoclostridium, Clostridium, Fusobacterium, Butyrivibrio, Eubacterium*, and *Treponema*. In some embodiments, the genetically engineered bacteria of the invention comprise butyrate biosynthesis genes from a different species, strain, or substrain of bacteria. In some embodiments, the genetically engineered bacteria comprise the eight genes of the butyrate biosynthesis pathway from *Peptoclostridium difficile*, e.g., *Peptoclostridium difficile* strain 630: bcd2, etfB3, etfA3, thiA1, hbd, crt2, pbt, and buk (Aboulnaga et al., 2013) and are capable of producing butyrate. *Peptoclostridium difficile* strain 630 and strain 1296 are both capable of producing butyrate, but comprise different nucleic acid sequences for etfA3, thiA1, hbd, crt2, pbt, and buk. In some embodiments, the genetically engineered bacteria comprise a combination of butyrogenic genes from different species, strains, and/or substrains of bacteria and are capable of producing butyrate. For example, in some embodiments, the genetically engineered bacteria comprise bcd2, etfB3, etfA3, and thiA1 from *Peptoclostridium difficile* strain 630, and hbd, crt2, pbt, and buk from *Peptoclostridium difficile* strain 1296. Alternatively, a single gene from *Treponema denticola* (ter, encoding trans-2-enoynl-CoA reductase) is capable of functionally replacing all three of the bcd2, etfB3, and etfA3 genes from *Peptoclostridium difficile*. Thus, a butyrogenic gene cassette may comprise thiA1, hbd, crt2, pbt, and buk from *Peptoclostridium difficile* and ter from *Treponema denticola*. In another example of a butyrate gene cassette, the pbt and buk genes are replaced with tesB (e.g., from *E. coli*). Thus a butyrogenic gene cassette may comprise ter, thiA1, hbd, crt2, and tesB.n some embodiments, the genetically engineered bacteria are capable of expressing the butyrate biosynthesis cassette and producing butyrate in low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose. One or more of the butyrate biosynthesis genes may be functionally replaced or modified, e.g., codon optimized.

In some embodiments, additional genes may be mutated or knocked out, to further increase the levels of butyrate production. Production under anaerobic conditions depends on endogenous NADH pools. Therefore, the flux through the butyrate pathway may be enhanced by eliminating competing routes for NADH utilization. Non-limiting examples of such competing routes are frdA (converts phosphoenolpyruvate to succinate), ldhA (converts pyruvate to lactate) and adhE (converts Acetyl-CoA to Ethanol). Thus, in certain embodiments, the genetically engineered bacteria further comprise mutations and/or deletions in one or more of frdA, ldhA, and adhE.

Table 6 depicts the nucleic acid sequences of exemplary genes in exemplary butyrate biosynthesis gene cassettes.

TABLE 6

Exemplary Butyrate Cassette Sequences

| Description | Sequence |
|---|---|
| bcd2<br>SEQ ID NO: 53 | ATGGATTTAAATTCTAAAAAATATCAGATGCTTAAAGAGCTATA<br>TGTAAGCTTCGCTGAAAATGAAGTTAAACCTTTAGCAACAGAAC<br>TTGATGAAGAAGAAAGATTTCCTTATGAAACAGTGGAAAAAATG<br>GCAAAAGCAGGAATGATGGGTATACCATATCCAAAAGAATATG<br>TGGAGAAGGTGGAGACACTGTAGGATATATAATGGCAGTTGAAG<br>AATTGTCTAGAGTTTGTGGTACTACAGGAGTTATATTATCAGCT<br>CATACATCTCTTGGCTCATGGCCTATATATCAATATGGTAATGA<br>AGAACAAAAACAAAAATTCTTAAGACCACTAGCAAGTGGAGAAA<br>AATTAGGAGCATTTGGTCTTACTGAGCCTAATGCTGGTACAGAT<br>GCGTCTGGCCAACAAACAACTGCTGTTTTAGACGGGGATGAATA<br>CATACTTAATGGCTCAAAAATATTTATAACAAACGCAATAGCTG<br>GTGACATATATGTAGTAATGGCAATGACTGATAAATCTAAGGGG<br>AACAAAGGAATATCAGCATTTATAGTTGAAAAAGGAACTCCTGG<br>GTTTAGCTTTGGAGTTAAAGAAAAGAAAATGGGTATAAGAGGTT<br>CAGCTACGAGTGAATTAATATTTGAGGATTGCAGAATACCTAAA<br>GAAAATTTACTTGGAAAAGAAGGTCAAGGATTTAAGATAGCAAT<br>GTCTACTCTTGATGGTGGTAGAATTGGTATAGCTGCACAAGCTT<br>TAGGTTTAGCACAAGGTGCTCTTGATGAAACTGTTAAATATGTA<br>AAAGAAAGAGTACAATTTGGTAGACCATTATCAAAATTCCAAAA<br>TACACAATTCCAATTAGCTGATATGGAAGTTAAGGTACAAGCGG<br>CTAGACACCTTGTATATCAAGCAGCTATAAATAAAGACTTAGGA<br>AAACCTTATGGAGTAGAAGCAGCAATGGCAAAATTATTTGCAGC<br>TGAAACAGCTATGGAAGTTACTACAAAAGCTGTACAACTTCATG<br>GAGGATATGGATACACTCGTGACTATCCAGTAGAAAGAATGATG<br>AGAGATGCTAAGATAACTGAAATATATGAAGGAACTAGTGAAGT<br>TCAAAGAATGGTTATTTCAGGAAAACTATTAAAATAG |
| etfB3<br>SEQ ID NO: 54 | ATGAATATAGTCGTTTGTATAAAACAAGTTCCAGATACAACAGA<br>AGTTAAACTAGATCCTAATACAGGTACTTTAATTAGAGATGGAG<br>TACCAAGTATAATAAACCCTGATGATAAAGCAGGTTTAGAAGAA<br>GCTATAAAATTAAAAGAAGAAATGGGTGCTCATGTAACTGTTAT<br>AACAATGGGACCTCCTCAAGCAGATATGGCTTTAAAAGAAGCTT<br>TAGCAATGGGTGCAGATAGAGGTATATTATTAACAGATAGAGCA<br>TTTGCGGGTGCTGATACTTGGGCAACTTCATCAGCATTAGCAGG<br>AGCATTAAAAAATATAGATTTTGATATTATAATAGCTGGAAGAC<br>AGGCGATAGATGGAGATACTGCACAAGTTGGACCTCAAATAGCT<br>GAACATTTAAATCTTCCATCAATAACATATGCTGAAGAAATAAA<br>AACTGAAGGTGAATATGTATTAGTAAAAAGACAATTTGAAGATT<br>GTTGCCATGACTTAAAAGTTAAAATGCCATGCCTTATAACAACT<br>CTTAAAGATATGAACACACCAGATACATGAAAGTTGGAAGAAT<br>ATATGATGCTTTCGAAAATGATGTAGTAGAAACATGGACTGTAA<br>AAGATATAGAAGTTGACCCTTCTAATTTAGGTCTTAAAGGTTCT<br>CCAACTAGTGTATTTAAATCATTTACAAAATCAGTTAAACCAGC<br>TGGTACAATATACAATGAAGATGCGAAAACATCAGCTGGAATTA<br>TCATAGATAAATTAAAAGAGAAGTATATCATATAA |
| etfA3<br>SEQ ID NO: 55 | ATGGGTAACGTTTTAGTAGTAATAGAACAAAGAGAAAATGTAAT<br>TCAAACTGTTTCTTTAGAATTACTAGGAAAGGCTACAGAAATAG<br>CAAAAGATTATGATACAAAAGTTTCTGCATTACTTTTAGGTAGT<br>AAGGTAGAAGGTTTAATAGATACATTAGCACACTATGGTGCAGA<br>TGAGGTAATAGTAGTAGATGATGAAGCTTTAGCAGTGTATACAA<br>CTGAACCATATACAAAAGCAGCTTATGAAGCAATAAAAGCAGCT<br>GACCCTATAGTTGTATTATTTGGTGCAACTTCAATAGGTAGAGA<br>TTTAGCGCCTAGAGTTTCTGCTAGAATACATACAGGTCTTACTG<br>CTGACTGTACAGGTCTTGCAGTAGCTGAAGATACAAAATTATTA<br>TTAATGACAAGACCTGCCTTTGGTGGAAATATAATGGCAACAAT<br>AGTTTGTAAAGATTTCAGACCTCAAATGTCTACAGTTAGACCAG<br>GGGTTATGAAGAAAAATGAACCTGATGAAACTAAAGAAGCTGTA<br>ATTAACCGTTTCAAGGTAGAATTTAATGATGCTGATAAATTAGT<br>TCAAGTTGTACAAGTAATAAAAGAAGCTAAAAAACAAGTTAAAA<br>TAGAAGATGCTAAGATATTAGTTTCTGCTGGACGTGGAATGGGT<br>GGAAAAGAAAACTTAGACATACTTTATGAATTAGCTGAAATTAT<br>AGGTGGAGAAGTTTCTGGTTCTCGTGCCACTATAGATGCAGGTT<br>GGTTAGATAAAGCAAGACAAGTTGGTCAAACTGGTAAAACTGTA<br>AGACCAGACCTTTATATAGCATGTGGTATATCTGGAGCAATACA<br>ACATATAGCTGGTATGGAAGATGCTGAGTTTATAGTTGCTATAA<br>ATAAAAATCCAGAAGCTCCAATATTTAAATATGCTGATGTTGGT<br>ATAGTTGGAGATGTTCATAAAGTGCTTCCAGAACTTATCAGTCA<br>GTTAAGTGTTGCAAAGAAAAAGGTGAAGTTTTAGCTAACTAA |
| thiA1<br>SEQ ID NO: 56 | ATGAGAGAAGTAGTAATTGCCAGTGCAGCTAGAACAGCAGTAGG<br>AAGTTTTGGAGGAGCATTTAAATCAGTTTCAGCGGTAGAGTTAG<br>GGGTAACAGCAGCTAAAGAAGCTATAAAAAGAGCTAACATAACT<br>CCAGATATGATAGATGAATCTCTTTTAGGGGGAGTACTTACAGC<br>AGGTCTTGGACAAAATATAGCAAGACAAATAGCATTAGGAGCAG<br>GAATACCAGTAGAAAAACCAGCTATGACTATAAATATAGTTTGT |

TABLE 6-continued

Exemplary Butyrate Cassette Sequences

| Description | Sequence |
|---|---|
| | GGTTCTGGATTAAGATCTGTTTCAATGGCATCTCAACTTATAGC<br>ATTAGGTGATGCTGATATAATGTTAGTTGGTGGAGCTGAAAACA<br>TGAGTATGTCTCCTTATTTAGTACCAAGTGCGAGATATGGTGCA<br>AGAATGGGTGATGCTGCTTTTGTTGATTCAATGATAAAAGATGG<br>ATTATCAGACATATTTAATAACTATCACATGGGTATTACTGCTG<br>AAAACATAGCAGAGCAATGGAATATAACTAGAGAAGAACAAGAT<br>GAATTAGCTCTTGCAAGTCAAATAAAGCTGAAAAAGCTCAAGC<br>TGAAGGAAAATTTGATGAAGAAATAGTTCCTGTTGTTATAAAG<br>GAAGAAAAGGTGACACTGTAGTAGATAAAGATGAATATATTAAG<br>CCTGGCACTACAATGGAGAAACTTGCTAAGTTAAGACCTGCATT<br>TAAAAAAGATGGAACAGTTACTGCTGGTAATGCATCAGGAATAA<br>ATGATGGTGCTGCTATGTTAGTAGTAATGGCTAAAGAAAAAGCT<br>GAAGAACTAGGAATAGAGCCTCTTGCAACTATAGTTTCTTATGG<br>AACAGCTGGTGTTGACCCTAAAATAATGGGATATGGACCAGTTC<br>CAGCAACTAAAAAAGCTTTAGAAGCTGCTAATATGACTATTGAA<br>GATATAGATTTAGTTGAAGCTAATGAGGCATTTGCTGCCCAATC<br>TGTAGCTGTAATAAGAGACTTAAATATAGATATGAATAAAGTTA<br>ATGTTAATGGTGGAGCAATAGCTATAGGACATCCAATAGGATGC<br>TCAGGAGCAAGAATACTTACTACACTTTTATATGAAATGAAGAG<br>AAGAGATGCTAAAACTGGTCTTGCTACACTTTGTATAGGCGGTG<br>GAATGGGAACTACTTTAATAGTTAAGAGATAG |
| hbd<br>SEQ ID NO: 57 | ATGAAATTAGCTGTAATAGGTAGTGGAACTATGGGAAGTGGTAT<br>TGTACAAACTTTTGCAAGTTGTGGACATGATGTATGTTTAAAGA<br>GTAGAACTCAAGGTGCTATAGATAAATGTTTAGCTTTATTAGAT<br>AAAAATTTAACTAAGTTAGTTACTAAGGGAAAAATGGATGAAGC<br>TACAAAAGCAGAATATTAAGTCATGTTAGTTCAACTACTAATT<br>ATGAAGATTTAAAAGATATGGATTTAATAATAGAAGCATCTGTA<br>GAAGACATGAATATAAAGAAAGATGTTTTCAAGTTACTAGATGA<br>ATTATGTAAAGAAGATACTATCTTGGCAACAAATACTTCATCAT<br>TATCTATAACAGAAATAGCTTCTTCTACTAAGCGCCCAGATAAA<br>GTTATAGGAATGCATTTCTTTAATCCAGTTCCTATGATGAAATT<br>AGTTGAAGTTATAAGTGGTCAGTTAACATCAAAAGTTACTTTTG<br>ATACAGTATTTGAATTATCTAAGAGTATCAATAAAGTACCAGTA<br>GATGTATCTGAATCTCCTGGATTTGTAGTAAATAGAATACTTAT<br>ACCTATGATAAATGAAGCTGTTGGTATATATGCAGATGGTGTTG<br>CAAGTAAAGAAGAAATAGATGAAGCTATGAAATTAGGAGCAAAC<br>CATCCAATGGGACCACTAGCATTAGGTGATTTAATCGGATTAGA<br>TGTTGTTTTAGCTATAATGAACGTTTTATATACTGAATTTGGAG<br>ATACTAAATATAGACCTCATCCACTTTTAGCTAAAATGGTTAGA<br>GCTAATCAATTAGGAAGAAAAACTAAGATAGGATTCTATGATTA<br>TAATAAATAA |
| crt2<br>SEQ ID NO: 58 | ATGAGTACAAGTGATGTTAAAGTTTATGAGAATGTAGCTGTTGA<br>AGTAGATGGAAATATATGTACAGTGAAAATGAATAGACCTAAAG<br>CCCTTAATGCAATAAATTCAAAGACTTTAGAAGAACTTTATGGA<br>GTATTTGTAGATATTAATAATGATGAAACTATTGATGTTGTAAT<br>ATTGACAGGGGAAGGAAAGGCATTTGTAGCTGGAGCAGATATTG<br>CATACATGAAAGATTTAGATGCTGTAGCTGCTAAAGATTTTAGT<br>ATCTTAGGAGCAAAAGCTTTTGGAGAAATAGAAAATAGTAAAA<br>AGTAGTGATAGCTGCTGTAAACGGATTTGCTTTAGGTGGAGGAT<br>GTGAACTTGCAATGGCATGTGATATAAGAATTGCATCTGCTAAA<br>GCTAAATTTGGTCAGCCAGAAGTAACTCTTGGAATAACTCCAGG<br>ATATGGAGGAACTCAAAGGCTTACAAGATTGGTTGGAATGGCAA<br>AAGCAAAAGAATTAATCTTTACGGTCAAGTTATAAAAGCTGAT<br>GAAGCTGAAAAAATAGGGCTAGTAAATAGAGTCGTTGAGCCAGA<br>CATTTTAATAGAAGAAGTTGAGAAATTAGCTAAGATAATAGCTA<br>AAAATGCTCAGCTTGCAGTTAGATACTCTAAAGAAGCAATACAA<br>CTTGGTGCTCAAACTGATATAAATACTGGAATAGATATAGAATC<br>TAATTTATTTGGTCTTTGTTTTTCAACTAAAGACCAAAAAGAAG<br>GAATGTCAGCTTTCGTTGAAAAGAGAGAAGCTAACTTTATAAAA<br>GGGTAA |
| pbt<br>SEQ ID NO: 59 | ATGAGAAGTTTTGAAGAAGTAATTAAGTTTGCAAAAGAAAGAGG<br>ACCTAAAACTATATCAGTAGCATGTTGCCAAGATAAAGAAGTTT<br>TAATGGCAGTTGAAATGGCTAGAAAAGAAAAAATAGCAAATGCC<br>ATTTTAGTAGGAGATATAGAAAAGACTAAAGAAATTGCAAAAAG<br>CATAGACATGGATATCGAAAATTATGAACTGATAGATATAAAAG<br>ATTTAGCAGAAGCATCTCTAAAATCTGTTGAATTAGTTTCACAA<br>GGAAAAGCCGACATGGTAATGAAAGGCTTAGTAGACACATCAAT<br>AATACTAAAAGCAGTTTTAAATAAAGAAGTAGGTCTTAGAACTG<br>GAAATGTATTAAGTCACGTAGCAGTATTTGATGTAGAGGGATAT<br>GATAGATTATTTTCGTAACTGACGCAGCTATGAACTTAGCTCC<br>TGATACAAATACTAAAAAGCAAATCATAGAAAATGCTTGCACAG<br>TAGCACATTCATTAGATATAAGTGAACCAAAAGTTGCTGCAATA<br>TGCGCAAAAGAAAAAGTAAATCCAAAAATGAAAGATACAGTTGA |

TABLE 6-continued

Exemplary Butyrate Cassette Sequences

| Description | Sequence |
|---|---|
| | AGCTAAAGAACTAGAAGAAATGTATGAAAGAGGAGAAATCAAAG<br>GTTGTATGGTTGGTGGGCCTTTTGCAATTGATAATGCAGTATCT<br>TTAGAAGCAGCTAAACATAAAGGTATAAATCATCCTGTAGCAGG<br>ACGAGCTGATATATTATTAGCCCCAGATATTGAAGGTGGTAACA<br>TATTATATAAAGCTTTGGTATTCTTCTCAAAATCAAAAAATGCA<br>GGAGTTATAGTTGGGGCTAAAGCACCAATAATATTAACTTCTAG<br>AGCAGACAGTGAAGAAACTAAACTAAACTCAATAGCTTTAGGTG<br>TTTTAATGGCAGCAAAGGCATAA |
| buk<br>SEQ ID NO: 60 | ATGAGCAAAATATTTAAAATCTTAACAATAAATCCTGGTTCGAC<br>ATCAACTAAAATAGCTGTATTTGATAATGAGGATTTAGTATTTG<br>AAAAAACTTTAAGACATTCTTCAGAAGAAATAGGAAAATATGAG<br>AAGGTGTCTGACCAATTTGAATTTCGTAAACAAGTAATAGAAGA<br>AGCTCTAAAAGAAGGTGGAGTAAAAACATCTGAATTAGATGCTG<br>TAGTAGGTAGAGGAGGACTTCTTAAACCTATAAAAGGTGGTACT<br>TATTCAGTAAGTGCTGCTATGATTGAAGATTTAAAAGTGGGAGT<br>TTTAGGAGAACACGCTTCAAACCTAGGTGGAATAATAGCAAAAC<br>AAATAGGTGAAGAAGTAAATGTTCCTTCATACATAGTAGACCCT<br>GTTGTTGTAGATGAATTAGAAGATGTTGCTAGAATTTCTGGTAT<br>GCCTGAAATAAGTAGAGCAAGTGTAGTACATGCTTTAAATCAAA<br>AGGCAATAGCAAGAAGATATGCTAGAGAAATAAACAAGAAATAT<br>GAAGATATAAATCTTATAGTTGCACACATGGGTGGAGGAGTTTC<br>TGTTGGAGCTCATAAAAATGGTAAAATAGTAGATGTTGCAAACG<br>CATTAGATGGAGAAGGACCTTTCTCTCCAGAAAGAAGTGGTGGA<br>CTACCAGTAGGTGCATTAGTAAAAATGTGCTTTAGTGGAAAATA<br>TACTCAAGATGAAATTAAAAAGAAAATAAAAGGTAATGGCGGAC<br>TAGTTGCATACTTAAACACTAATGATGCTAGAGAAGTTGAAGAA<br>AGAATTGAAGCTGGTGATGAAAAAGCTAAATTAGTATATGAAGC<br>TATGGCATATCAAATCTCTAAAGAAATAGGAGCTAGTGCTGCAG<br>TTCTTAAGGGAGATGTAAAAGCAATATTATTAACTGGTGGAATC<br>GCATATTCAAAAATGTTTACAGAAATGATTGCAGATAGAGTTAA<br>ATTTATAGCAGATGTAAAAGTTTATCCAGGTGAAGATGAAATGA<br>TTGCATTAGCTCAAGGTGGACTTAGAGTTTTAACTGGTGAAGAA<br>GAGGCTCAAGTTTATGATAACTAA |
| ter<br>SEQ ID NO: 61 | ATGATCGTAAAACCTATGGTACGCAACAATATCTGCCTGAACGC<br>CCATCCTCAGGGCTGCAAGAAGGGAGTGGAAGATCAGATTGAAT<br>ATACCAAGAAACGCATTACCGCAGAAGTCAAAGCTGGCGCAAAA<br>GCTCCAAAAAACGTTCTGGTGCTTGGCTGCTCAAATGGTTACGG<br>CCTGGCGAGCCGCATTACTGCTGCGTTCGGATACGGGGCTGCGA<br>CCATCGGCGTGTCCTTTGAAAAAGCGGGTTCAGAAACCAAATAT<br>GGTACACCGGGATGGTACAATAATTTGGCATTTGATGAAGCGGC<br>AAAACGCGAGGGTCTTTATAGCGTGACGATCGACGGCGATGCGT<br>TTTCAGACGAGATCAAGGCCCAGGTAATTGAGGAAGCCAAAAAA<br>AAAGGTATCAAATTTGATCTGATCGTATACAGCTTGGCCAGCCC<br>AGTACGTACTGATCCTGATACAGGTATCATGCACAAAAGCGTTT<br>TGAAACCCTTTGGAAAAACGTTCACAGGCAAAACAGTAGATCCG<br>TTTACTGGCGAGCTGAAGGAAATCTCCGCGGAACCAGCAAATGA<br>CGAGGAAGCAGCCGCCACTGTTAAAGTTATGGGGGGTGAAGATT<br>GGGAACGTTGGATTAAGCAGCTGTCGAAGGAAGGCCTCTTAGAA<br>GAAGGCTGTATTACCTTGGCCTATAGTTATATTGGCCCTGAAGC<br>TACCCAAGCTTTGTACCGTAAAGGCACAATCGGCAAGGCCAAAG<br>AACACCTGGAGGCCACAGCACACCGTCTCAACAAAGAGAACCCG<br>TCAATCCGTGCCTTCGTGAGCGTGAATAAAGGCCTGGTAACCCG<br>CGCAAGCGCCGTAATCCCGGTAATCCCTCTGTATCTCGCCAGCT<br>TGTTCAAAGTAATGAAAGAGAAGGGCAATCATGAAGGTTGTATT<br>GAACAGATCACGCGTCTGTACGCCGAGCGCCTGTACCGTAAAGA<br>TGGTACAATTCCAGTTGATGAGGAAATCGCATTCGCATTGATG<br>ATTGGGAGTTAGAAGAAGACGTCCAGAAAGCGGTATCCGCGTTG<br>ATGGAGAAAGTCACGGGTGAAAACGCAGAATCTCTCACTGACTT<br>AGCGGGGTACCGCCATGATTTCTTAGCTAGTAACGGCTTTGATG<br>TAGAAGGTATTAATTATGAAGCGGAAGTTGAACGCTTCGACCGT<br>ATCTGA |
| tesB<br>SEQ ID NO: 15 | ATGAGTCAGGCGCTAAAAAATTTACTGACATTGTTAAATCTGGA<br>AAAAATTGAGGAAGGACTCTTTCGCGGCCAGAGTGAAGATTTAG<br>GTTTACGCCAGGTGTTTGGCGGCCAGGTCGTGGGTCAGGCCTTG<br>TATGCTGCAAAAGAGACCGTCCCTGAAGAGCGGCTGGTACATTC<br>GTTTCACAGCTACTTTCTTCGCCCTGGCGATAGTAAGAAGCCGA<br>TTATTTATGATGTCGAAACGCTGCGTGACGGTAACAGCTTCAGC<br>GCCCGCCGGGTTGCTGCTATTCAAAACGGCAAACCGATTTTTTA<br>TATGACTGCCTCTTTCCAGGCACCAGAAGCGGGTTTCGAACATC<br>AAAAAACAATGCCGTCCGCGCCAGCGCCTGATGGCCTCCCTTCG<br>GAAACGCAAATCGCCCAATCGCTGGCGCACCTGCTGCCGCCAGT<br>GCTGAAAGATAAATTCATCTGCGATCGTCCGCTGGAAGTCCGTC<br>CGGTGGAGTTTCATAACCCACTGAAAGGTCACGTCGCAGAACCA</td></tr>

TABLE 6-continued

Exemplary Butyrate Cassette Sequences

| Description | Sequence |
|---|---|
| | CATCGTCAGGTGTGGATCCGCGCAAATGGTAGCGTGCCGGATGA<br>CCTGCGCGTTCATCAGTATCTGCTCGGTTACGCTTCTGATCTTA<br>ACTTCCTGCCGGTAGCTCTACAGCCGCACGGCATCGGTTTTCTC<br>GAACCGGGGATTCAGATTGCCACCATTGACCATTCCATGTGGTT<br>CCATCGCCCGTTTAATTTGAATGAATGGCTGCTGTATAGCGTGG<br>AGAGCACCTCGGCGTCCAGCGCACGTGGCTTTGTGCGCGGTGAG<br>TTTTATACCCAAGACGGCGTACTGGTTGCCTCGACCGTTCAGGA<br>AGGGGTGATGCGTAATCACAATTAA |

Exemplary polypeptide sequences for the production of butyrate by the genetically engineered bacteria are provided in Table 7.

TABLE 7

Exemplary Polypeptide Sequences for Butyrate Production

| Description | Sequence |
|---|---|
| Bcd2<br>SEQ ID NO: 62 | MDLNSKKYQMLKELYVSFAENEVKPLATELDEEERF<br>PYETVEKMAKAGMMGIPYPKEYGGEGGDTVGYIMAV<br>EELSRVCGTTGVILSAHTSLGSWPIYQYGNEEQKQK<br>FLRPLASGEKLGAFGLTEPNAGTDASGQQTTAVLDG<br>DEYILNGSKIFITNAIAGDIYVVMAMTDKSKGNKGI<br>SAFIVEKGTPGESFGVKEKKMGIRGSATSELIFEDC<br>RIPKENLLGKEGQGFKIAMSTLDGGRIGIAAQALGL<br>AQGALDETVKYVKERVQFGRPLSKFQNTQFQLADME<br>VKVQAARHLVYQAAINKDLGKPYGVEAAMAKLFAAE<br>TAMEVTTKAVQLHGGYGYTRDYPVERMMRDAKITEI<br>YEGTSEVQRMVISGKLLK |
| etfB3<br>SEQ ID NO: 63 | MNIVVCIKQVPDTTEVKLDPNTGTLIRDGVPSIINP<br>DDKAGLEEAIKLKEEMGAHVTVITMGPPQADMALKE<br>ALAMGADRGILLTDRAFAGADTWATSSALAGALKNI<br>DFDIIIAGRQAIDGDTAQVGPQIAEHLNLPSITYAE<br>EIKTEGEYVLVKRQFEDCCHDLKVKMPCLITTLKDM<br>NTPRYMKVGRIYDAFENDVVETWTVKDIEVDPSNLG<br>LKGSPTSVEKSETKSVKPAGTIYNEDAKTSAGIIID<br>KLKEKYII |
| etfA3<br>SEQ ID NO: 64 | MGNVLVVIEQRENVIQTVSLELLGKATEIAKDYDTK<br>VSALLLGSKVEGLIDTLAHYGADEVIVVDDEALAVY<br>TTEPYTKAAYEAIKAADPIVVLFGATSIGRDLAPRV<br>SARIHTGLTADCTGLAVAEDTKLLLMTRPAFGGNIM<br>ATIVCKDFRPQMSTVRPGVMKKNEPDETKEAVINRF<br>KVEFNDADKLVQVVQVIKEAKKQVKIEDAKILVSAG<br>RGMGGKENLDILYELAEIIGGEVSGSRATIDAGWLD<br>KARQVGQTGKTVRPDLYIACGISGAIQHIAGMEDAE<br>FIVAINKNPEAPIFKYADVGIVGDVHKVLPELISQL<br>SVAKEKGEVLAN |
| Ter<br>SEQ ID NO: 65 | MIVKPMVRNNICLNAHPQGCKKGVEDQIEYTKKRIT<br>AEVKAGAKAPKNVLVLGCSNGYGLASRITAAFGYGA<br>ATIGVSFEKAGSETKYGTPGWYNNLAFDEAAKREGL<br>YSVTIDGDAFSDEIKAQVIEEAKKKGIKFDLIVYSL<br>ASPVRTDPDTGIMHKSVLKPFGKTFTGKTVDPFTGE<br>LKEISAEPANDEEAAATVKVMGGEDWERWIKQLSKE<br>GLLEEGCITLAYSYIGPEATQALYRKGTIGKAKEHL<br>EATAHRLNKENPSIRAFVSVNKGLVTRASAVIPVIP<br>LYLASLFKVMKEKGNHEGCIEQITRLYAERLYRKDG<br>TIPVDEENRIRIDDWELEEDVQKAVSALMEKVTGEN<br>AESLTDLAGYRHDFLASNGFDVEGINYEAEVERFDRI |
| ThiA<br>SEQ ID NO: 66 | MREVVIASAARTAVGSFGGAFKSVSAVELGVTAAKE<br>AIKRANITPDMIDESLLGGVLTAGLGQNIARQIALG<br>AGIPVEKPAMTINIVCGSGLRSVSMASQLIALGDAD<br>IMLVGGAENMSMSPYLVPSARYGARMGDAAFVDSMI<br>KDGLSDIFNNYHMGITAENIAEQWNITREEQDELAL<br>ASQNKAEKAQAEGKFDEEIVPVVIKGRKGDTVVDKD<br>EYIKPGTTMEKLAKLRPAFKKDGTVTAGNASGINDG<br>AAMLVVMAKEKAEELGIEPLATIVSYGTAGVDPKIM<br>GYGPVPATKKALEAANMTTEDIDLVEANEAFAAQSV |

TABLE 7-continued

Exemplary Polypeptide Sequences for Butyrate Production

| Description | Sequence |
|---|---|
| | AVIRDLNIDMNKVNVNGGAIAIGHPIGCSGARILTT<br>LLYEMKRRDAKTGLATLCIGGGMGTTLIVKR |
| Hbd<br>SEQ ID NO: 67 | MKLAVIGSGTMGSGIVQTFASCGHDVCLKSRTQGAI<br>DKCLALLDKNLTKLVTKGKMDEATKAEILSHVSSTT<br>NYEDLKDMDLIIEASVEDMNIKKDVFKLLDELCKED<br>TILATNTSSLSITEIASSTKRPDKVIGMHFFNPVPM<br>MKLVEVISGQLTSKVTFDTVFELSKSINKVPVDVSE<br>SPGFVVNRILIPMINEAVGIYADGVASKEEIDEAMK<br>LGANHPMGPLALGDLIGLDVVLAIMNVLYTEFGDTK<br>YRPHPLLAKMVRANQLGRKTKIGFYDYNK |
| Crt2<br>SEQ ID NO: 68 | MSTSDVKVYENVAVEVDGNICTVKMNRPKALNAINS<br>KTLEELYEVFVDINNDETIDVVILTGEGKAFVAGAD<br>IAYMKDLDAVAAKDFSILGAKAFGEIENSKKVVIAA<br>VNGFALGGGCELAMACDIRIASAKAKFGQPEVTLGI<br>TPGYGGTQRLTRLVGMAKAKELIFTGQVIKADEAEK<br>IGLVNRVVEPDILIEEVEKLAKIIAKNAQLAVRYSK<br>EAIQLGAQTDINTGIDIESNLFGLCFSTKDQKEGMS<br>AFVEKREANFIKG |
| Pbt<br>SEQ ID NO: 69 | MRSFEEVIKFAKERGPKTISVACCQDKEVLMAVEMA<br>RKEKIANAILVGDIEKTKEIAKSIDMDIENYELIDI<br>KDLAEASLKSVELVSQGKADMVMKGLVDTSIILKAV<br>LNKEVGLRTGNVLSHVAVFDVEGYDRLFFVTDAAMN<br>LAPDTNTKKQIIENACTVAHSLDISEPKVAAICAKE<br>KVNPKMKDTVEAKELEEMYERGEIKGCMVGGPFAID<br>NAVSLEAAKHKGINHPVAGRADILLAPDIEGGNILY<br>KALVFFSKSKNAGVIVGAKAPIILTSRADSEETKLN<br>SIALGVLMAAKA |
| Buk<br>SEQ ID NO: 70 | MSKIFKILTINPGSTSTKIAVFDNEDLVFEKTLRHS<br>SEEIGKYEKVSDQFEFRKQVIEEALKEGGVKTSELD<br>AVVGRGGLLKPIKGGTYSVSAAMIEDLKVGVLGEHA<br>SNLGGIIAKQIGEEVNVPSYIVDPVVVDELEDVARI<br>SGMPEISRASVVHALNQKAIARRYAREINKKYEDIN<br>LIVAHMGGGVSVGAHKNGKIVDVANALDGEGPFSPE<br>RSGGLPVGALVKMCFSGKYTQDEIKKKIKGNGGLVA<br>YLNTNDAREVEERIEAGDEKAKLVYEAMAYQISKEI<br>GASAAVLKGDVKAILLTGGIAYSKMFTEMIADRVKF<br>IADVKVYPGEDEMIALAQGGLRVLTGEEEAQVYDN |
| TesB<br>SEQ ID NO: 41 | MSQALKNLLTLLNLEKIEEGLFRGQSEDLGLRQVFG<br>GQVVGQALYAAKETVPEERLVHSFHSYFLRPGDSKK<br>PIIYDVETLRDGNSFSARRVAAIQNGKPIFYMTASF<br>QAPEAGFEHQTMPSAPAPDGLPSETQIAQSLAHLL<br>PPVLKDKFICDRPLEVRPVEFHNPLKGHVAEPHRQV<br>WIRANGSVPDDLRVHQYLLGYASDLNFLPVALQPHG<br>IGFLEPGIQIATIDHSMWFHRPFNLNEWLLYSVEST<br>SASSARGFVRGEFYTQDGVLVASTVQEGVMRNHN* |

The gene products of the bcd2, etfA3, and etfB3 genes in *Clostridium difficile* form a complex that converts crotonyl-CoA to butyryl-CoA, which may function as an oxygen-dependent co-oxidant. In some embodiments, because the genetically engineered bacteria of the invention are designed to produce butyrate in a microaerobic or oxygen-limited environment, e.g., the mammalian gut, oxygen dependence could have a negative effect on butyrate production in the gut. It has been shown that a single gene from *Treponema denticola* (ter, encoding trans-2-enoynl-CoA reductase) can functionally replace this three-gene complex in an oxygen-independent manner. In some embodiments, the genetically engineered bacteria comprise a ter gene, e.g., from *Treponema denticola*, which can functionally replace all three of the bcd2, etfB3, and etfA3 genes, e.g., from *Peptoclostridium difficile*. In this embodiment, the genetically engineered bacteria comprise thiA1, hbd, crt2, pbt, and buk, e.g., from *Peptoclostridium difficile*, and ter, e.g., from *Treponema denticola*, and produce butyrate in low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose.

In some embodiments, the genetically engineered bacteria of the invention comprise thiA1, hbd, crt2, pbt, and buk, e.g., from *Peptoclostridium difficile*; ter, e.g., from *Treponema denticola*; one or more of bcd2, etfB3, and etfA3, e.g., from *Peptoclostridium difficile*; and produce butyrate in low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose. In some embodiments, one or more of the butyrate biosynthesis genes is functionally replaced, modified, and/or mutated in order to enhance stability and/or increase butyrate production in low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose.

The gene products of pbt and buk convert butyrylCoA to Butyrate. In some embodiments, the pbt and buk genes can be replaced by a tesB gene. tesB can be used to cleave off the CoA from butyryl-coA. In one embodiment, the genetically engineered bacteria comprise bcd2, etfB3, etfA3, thiA1, hbd, and crt2, e.g., from *Peptoclostridium difficile*, and tesB from *E. coli* and produce butyrate in low-oxygen conditions, in the presence of molecules or metabolites, in the presence of molecules or metabolites associated with liver damage, inflammation or an inflammatory response, or in the presence of some other metabolite that may or may not be present in the gut, such as arabinose. In one embodiment, the genetically engineered bacteria comprise ter gene (encoding trans-2-enoynl-CoA reductase) e.g., from *Treponema denticola*, thiA1, hbd, crt2, pbt, and buk, e.g., from *Peptoclostridium difficile*, and tesB from *E. coli*, and produce butyrate in low-oxygen conditions, in the presence of specific molecules or metabolites, in the presence of molecules or metabolites associated with liver damage, inflammation or an inflammatory response, or in the presence of some other metabolite that may or may not be present in the gut, such as arabinose. In some embodiments, one or more of the butyrate biosynthesis genes is functionally replaced, modified, and/or mutated in order to enhance stability and/or increase butyrate production in low-oxygen conditions or in the presence of specific molecules or metabolites, or molecules or metabolites associated with hunger, appetite, craving, obesity, metablic syndrome, insulin resistance, liver damage, or other condition(s) such as inflammation or an inflammatory response, or in the presence of some other metabolite that may or may not be present in the gut, such as arabinose.

In some embodiments, the local production of butyrate induces the differentiation of regulatory T cells in the gut and/or promotes the barrier function of colonic epithelial cells. In some embodiments, the genetically engineered bacteria comprise genes for aerobic butyrate biosynthesis and/or genes for anaerobic or microaerobic butyrate biosynthesis.

In some embodiments, the local production of butyrate protects against diet-induced obesity (Lin et al., 2012). In some embodiments, the local production of butyrate protects against diet-induced obesity without causing decreased food intake (Lin et al., 2012). In some embodiments, local butyrate production reduces gut inflammation, a symptom of metabolic disease.

In one embodiment, the bcd2 gene has at least about 80% identity with SEQ ID NO: 53. In another embodiment, the bcd2 gene has at least about 85% identity with SEQ ID NO: 53. In one embodiment, the bcd2 gene has at least about 90% identity with SEQ ID NO: 53. In one embodiment, the bcd2 gene has at least about 95% identity with SEQ ID NO: 53. In another embodiment, the bcd2 gene has at least about 96%, 97%, 98%, or 99% identity with SEQ ID NO: 53. Accordingly, in one embodiment, the bcd2 gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 53. In another embodiment, the bcd2 gene comprises the sequence of SEQ ID NO: 53. In yet another embodiment the bcd2 gene consists of the sequence of SEQ ID NO: 53.

In one embodiment, the etfB3 gene has at least about 80% identity with SEQ ID NO: 54. In another embodiment, the etfB3 gene has at least about 85% identity with SEQ ID NO: 54. In one embodiment, the etfB3 gene has at least about 90% identity with SEQ ID NO: 54. In one embodiment, the etfB3 gene has at least about 95% identity with SEQ ID NO: 54. In another embodiment, the etfB3 gene has at least about 96%, 97%, 98%, or 99% identity with SEQ ID NO: 54. Accordingly, in one embodiment, the etfB3 gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 54. In another embodiment, the etfB3 gene comprises the sequence of SEQ ID NO: 54. In yet another embodiment the etfB3 gene consists of the sequence of SEQ ID NO: 54.

In one embodiment, the etfA3 gene has at least about 80% identity with SEQ ID NO: 55. In another embodiment, the etfA3 gene has at least about 85% identity with SEQ ID NO: 55. In one embodiment, the etfA3 gene has at least about 90% identity with SEQ ID NO: 55. In one embodiment, the etfA3 gene has at least about 95% identity with SEQ ID NO: 55. In another embodiment, the etfA3 gene has at least about 96%, 97%, 98%, or 99% identity with SEQ ID NO: 55. Accordingly, in one embodiment, the etfA3 gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 55. In another embodiment, the etfA3 gene comprises the sequence of SEQ ID NO: 55. In yet another embodiment the etfA3 gene consists of the sequence of SEQ ID NO: 55.

In one embodiment, the thiA1 gene has at least about 80% identity with SEQ ID NO: 56. In another embodiment, the thiA1 gene has at least about 85% identity with SEQ ID NO: 56. In one embodiment, the thiA1 gene has at least about 90% identity with SEQ ID NO: 56. In one embodiment, the thiA1 gene has at least about 95% identity with SEQ ID NO: 56. In another embodiment, the thiA1 gene has at least about 96%, 97%, 98%, or 99% identity with SEQ ID NO: 56. Accordingly, in one embodiment, the thiA1 gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 56. In another embodiment, the thiA1 gene comprises the sequence of SEQ ID NO: 56. In yet another embodiment the thiA1 gene consists of the sequence of SEQ ID NO: 56.

In one embodiment, the hbd gene has at least about 80% identity with SEQ ID NO: 57. In another embodiment, the hbd gene has at least about 85% identity with SEQ ID NO: 57. In one embodiment, the hbd gene has at least about 90% identity with SEQ ID NO: 57. In one embodiment, the hbd gene has at least about 95% identity with SEQ ID NO: 57. In another embodiment, the hbd gene has at least about 96%, 97%, 98%, or 99% identity with SEQ ID NO: 57. Accordingly, in one embodiment, the hbd gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 57. In another embodiment, the hbd gene comprises the sequence of SEQ ID NO: 57. In yet another embodiment the hbd gene consists of the sequence of SEQ ID NO: 57.

In one embodiment, the crt2 gene has at least about 80% identity with SEQ ID NO: 58. In another embodiment, the crt2 gene has at least about 85% identity with SEQ ID NO: 58. In one embodiment, the crt2 gene has at least about 90% identity with SEQ ID NO: 58. In one embodiment, the crt2 gene has at least about 95% identity with SEQ ID NO: 58. In another embodiment, the crt2 gene has at least about 96%, 97%, 98%, or 99% identity with SEQ ID NO: 58. Accordingly, in one embodiment, the crt2 gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 58. In another embodiment, the crt2 gene comprises the sequence of SEQ ID NO: 58. In yet another embodiment the crt2 gene consists of the sequence of SEQ ID NO: 58.

In one embodiment, the pbt gene has at least about 80% identity with SEQ ID NO: 59. In another embodiment, the pbt gene has at least about 85% identity with SEQ ID NO: 59. In one embodiment, the pbt gene has at least about 90% identity with SEQ ID NO: 59. In one embodiment, the pbt gene has at least about 95% identity with SEQ ID NO: 59. In another embodiment, the pbt gene has at least about 96%, 97%, 98%, or 99% identity with SEQ ID NO: 59. Accordingly, in one embodiment, the pbt gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 59. In another embodiment, the pbt gene comprises the sequence of SEQ ID NO: 59. In yet another embodiment the pbt gene consists of the sequence of SEQ ID NO: 59.

In one embodiment, the buk gene has at least about 80% identity with SEQ ID NO: 60. In another embodiment, the buk gene has at least about 85% identity with SEQ ID NO: 60. In one embodiment, the buk gene has at least about 90% identity with SEQ ID NO: 60. In one embodiment, the buk gene has at least about 95% identity with SEQ ID NO: 60. In another embodiment, the buk gene has at least about 96%, 97%, 98%, or 99% identity with SEQ ID NO: 60. Accordingly, in one embodiment, the buk gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 60. In another embodiment, the buk gene comprises the sequence of SEQ ID NO: 60. In yet another embodiment the buk gene consists of the sequence of SEQ ID NO: 60.

In one embodiment, the ter gene has at least about 80% identity with SEQ ID NO: 61. In another embodiment, the ter gene has at least about 85% identity with SEQ ID NO: 61. In one embodiment, the ter gene has at least about 90% identity with SEQ ID NO: 61. In one embodiment, the ter gene has at least about 95% identity with SEQ ID NO: 61. In another embodiment, the ter gene has at least about 96%, 97%, 98%, or 99% identity with SEQ ID NO: 61. Accordingly, in one embodiment, the ter gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 61. In another embodiment, the ter gene comprises the sequence of SEQ ID NO: 61. In yet another embodiment the ter gene consists of the sequence of SEQ ID NO: 61.

In one embodiment, the tesB gene has at least about 80% identity with SEQ ID NO: 15. In another embodiment, the tesB gene has at least about 85% identity with SEQ ID NO: 15. In one embodiment, the tesB gene has at least about 90% identity with SEQ ID NO: 15. In one embodiment, the tesB gene has at least about 95% identity with SEQ ID NO: 15. In another embodiment, the tesB gene has at least about 96%, 97%, 98%, or 99% identity with SEQ ID NO: 15. Accordingly, in one embodiment, the tesB gene has at least about 80%, 81%, 82%, 83%, 84%, 85%, 86%, 87%, 88%, 89%, 90%, 91%, 92%, 93%, 94%, 95%, 96%, 97%, 98%, or 99% identity with SEQ ID NO: 15. In another embodiment, the tesB gene comprises the sequence of SEQ ID NO: 15. In yet another embodiment the tesB gene consists of the sequence of SEQ ID NO: 15.

In one embodiment, one or more polypeptides encoded by the butyrate circuits and expressed by the genetically engineered bacteria have at least about 80% identity with one or more of SEQ ID NO: 62 through SEQ ID NO: 70, and SEQ ID NO: 41. In another embodiment, one or more polypeptides encoded by the butyrate circuits and expressed by the genetically engineered bacteria have at least about 85% identity with one or more of SEQ ID NO: 62 through SEQ ID NO: 70, and SEQ ID NO: 41. In one embodiment, one or more polypeptides encoded by the butyrate circuits and expressed by the genetically engineered bacteria have at least about 90% identity with one or more of SEQ ID NO: 62 through SEQ ID NO: 70, and SEQ ID NO: 41. In one embodiment, one or more polypeptides encoded by the butyrate circuits and expressed by the genetically engineered bacteria have at least about 95% identity with one or more of SEQ ID NO: 62 through SEQ ID NO: 70, and SEQ ID NO: 41. In another embodiment, one or more polypeptides encoded by the butyrate circuits and expressed by the genetically engineered bacteria have at least about 96%, 97%, 98%, or 99% identity with one or more of SEQ ID NO: 62 through SEQ ID NO: 70, and SEQ ID NO: 41. Accordingly, in one embodiment, one or more polypeptides encoded by the butyrate circuits and expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with with one or more of SEQ ID NO: 62 through SEQ ID NO: 70, and SEQ ID NO: 41. In another embodiment, one or more polypeptides encoded by the butyrate circuits and expressed by the genetically engineered bacteria one or more polypeptides encoded by the butyrate circuits and expressed by the genetically engineered bacteria comprise the sequence of with one or more of SEQ ID NO: 62 through SEQ ID NO: 70, and SEQ ID NO: 41. In yet another embodiment one or more polypeptides encoded by the butyrate circuits and expressed by the genetically engineered bacteria consist of the sequence of with one or more of SEQ ID NO: 62 through SEQ ID NO: 70, and SEQ ID NO: 41.

In some embodiments, one or more of the butyrate biosynthesis genes is a synthetic butyrate biosynthesis gene. In some embodiments, one or more of the butyrate biosynthesis genes is a *Treponema denticola* butyrate biosynthesis gene. In some embodiments, one or more of the butyrate biosynthesis genes is a *C. glutamicum* butyrate biosynthesis gene. In some embodiments, one or more of the butyrate biosynthesis genes is a *Peptoclostridicum difficile* butyrate biosynthesis gene. The butyrate gene cassette may comprise genes for the aerobic biosynthesis of butyrate and/or genes for the anaerobic or microaerobic biosynthesis of butyrate.

In some embodiments, the genetically engineered bacteria comprise a combination of butyrate biosynthesis genes from different species, strains, and/or substrains of bacteria, and are capable of producing butyrate. In some embodiments, one or more of the butyrate biosynthesis genes is functionally replaced, modified, and/or mutated in order to enhance stability and/or increase butyrate production. In some embodiments, the local production of butyrate reduces food intake and ameliorates metabolic disease (Lin et al., 2012). In some embodiments, the genetically engineered bacteria are capable of expressing the butyrate biosynthesis cassette and producing butyrate in low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose.

In one embodiment, the butyrate gene cassette is directly operably linked to a first promoter. In another embodiment, the butyrate gene cassette is indirectly operably linked to a first promoter. In one embodiment, the promoter is not operably linked with the butyrate gene cassette in nature.

In some embodiments, the butyrate gene cassette is expressed under the control of a constitutive promoter. In another embodiment, the butyrate gene cassette is expressed under the control of an inducible promoter. In some embodiments, the butyrate gene cassette is expressed under the control of a promoter that is directly or indirectly induced by exogenous environmental conditions. In one embodiment, the butyrate gene cassette is expressed under the control of a promoter that is directly or indirectly induced by low-oxygen or anaerobic conditions, wherein expression of the butyrate gene cassette is activated under low-oxygen or anaerobic environments, such as the environment of the mammalian gut. Inducible promoters are described in more detail infra.

The butyrate gene cassette may be present on a plasmid or chromosome in the bacterial cell. In one embodiment, the butyrate gene cassette is located on a plasmid in the bacterial cell. In another embodiment, the butyrate gene cassette is located in the chromosome of the bacterial cell. In yet another embodiment, a native copy of the butyrate gene cassette is located in the chromosome of the bacterial cell, and a butyrate gene cassette from a different species of bacteria is located on a plasmid in the bacterial cell. In yet another embodiment, a native copy of the butyrate gene cassette is located on a plasmid in the bacterial cell, and a butyrate gene cassette from a different species of bacteria is located on a plasmid in the bacterial cell. In yet another embodiment, a native copy of the butyrate gene cassette is located in the chromosome of the bacterial cell, and a butyrate gene cassette from a different species of bacteria is located in the chromosome of the bacterial cell.

In some embodiments, the butyrate gene cassette is expressed on a low-copy plasmid. In some embodiments, the butyrate gene cassette is expressed on a high-copy plasmid. In some embodiments, the high-copy plasmid may be useful for increasing expression of butyrate.

Acetate

In some embodiments, the genetically engineered bacteria of the invention comprise an acetate gene cassette and produce acetate under particular exogenous environmental conditions. The genetically engineered bacteria may include any suitable set of acetate biosynthesis genes. Unmodified bacteria comprising acetate biosynthesis genes are known in the art and are capable of consuming various substrates to produce acetate under aerobic and/or anaerobic conditions (see, e.g., Ragsdale et al., 2008). In some embodiments, the genetically engineered bacteria of the invention comprise acetate biosynthesis genes from a different species, strain, or substrain of bacteria. In some embodiments, the native acetate biosynthesis genes in the genetically engineered bacteria are enhanced. In some embodiments, the genetically engineered bacteria comprise aerobic acetate biosynthesis genes, e.g., from *Escherichia coli*. In some embodiments, the genetically engineered bacteria comprise anaerobic acetate biosynthesis genes, e.g., from *Acetitomaculum, Acetoanaerobium, Acetohalobium, Acetonema, Balutia, Butyribacterium, Clostridium, Moorella, Oxobacter, Sporomusa*, and/or *Thermoacetogenium*. The genetically engineered bacteria may comprise genes for aerobic acetate biosynthesis or genes for anaerobic or microaerobic acetate biosynthesis. In some embodiments, the genetically engineered bacteria comprise both aerobic and anaerobic or microaerobic acetate biosynthesis genes. In some embodiments, the genetically engineered bacteria comprise a combination of acetate biosynthesis genes from different species, strains, and/or substrains of bacteria, and are capable of producing acetate. In some embodiments, one or more of the acetate biosynthesis genes is functionally replaced, modified, and/or mutated in order to enhance stability and/or acetate production. In some embodiments, the genetically engineered bacteria are capable of expressing the acetate biosynthesis cassette and producing acetate in low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose. In some embodiments, the genetically engineered bacteria are capable of producing an alternate short-chain fatty acid.

GLP-1

In some embodiments, the genetically engineered bacteria of the invention are capable of producing GLP-1 or proglucagon. GLP-1 and several other insulin and satiety regulating peptides result from cleaved of preproglucagon. Preproglucagon is proteolytically cleaved in a tissue-specific manner. Post-translational processing in the gut and brain by prohormone convertases results in the secretion of GLP-1 and GLP-2, while the glucagon sequence remains in a larger peptide, glicentin or glicentin-related pancreatic peptide (GRPP) and oxyntomodulin. Glucagon-like peptide 1 (GLP-1) is produced by intestinal cells, e.g., ileal L cells, and is capable of stimulating insulin secretion and the differentiation of insulin-secreting cells and inhibiting glucagon secretion. GLP-1 is capable of restoring glucose sensitivity and increasing satiety.

Glucagon-like peptide 1 (GLP-1) is also used to treat those suffering from non-alcoholic steatohepatitis by reducing the degree of lipotoxic metabolites, pro-inflammatory substrate, and hepatic lipid deposition. Glucagon-like peptide 1 is well known to those of skill in the art. For example, glucagon-like peptide 1 has been used to stimulate insulin secretion in the treatment of type-two diabetes and non-alcoholic steatohepatitis (NASH). See, for example, Armstrong, et al., J. of Hepatology, 64:399-408 (2016); Bernsmeier, et al., PLOS One, 9(1): e87488 (2014); Kjems, et al., Diabetes, 52:380-386 (2003); Knudsen et al., J. Med. Chem., 43:1664-1669 (2000); MacDonald, et al., Diabetes, 51(supp. 3):5434-5442 (2002); Werner, et al., Regulatory Peptides, 164:58-34 (2010); Drucker and Nauck, Lancet, 368:1696-1705 (2006); Jiminez-Solem, et al., Cur. Opinion in Mol. Therap., 12(6):760-797 (2010); Schnabel, et al., Vasc. Health and Risk Mgmt., 2(1):69-77 (2006); and WO1995/017510, the entire contents of each of which are expressly incorporated herein by reference.

Proteolytic cleavage of proglucagon produces GLP-1 and GLP-2. GLP-1 administration has therapeutic potential in treating type 2 diabetes (Gallwitz et al., 2000). The genetically engineered bacteria may comprise any suitable gene encoding GLP-1 or proglucagon, e.g., human GLP-1 or proglucagon. In some embodiments, a protease inhibitor, e.g., an inhibitor of dipeptidyl peptidase, is also administered to decrease GLP-1 degradation. In some embodiments, the genetically engineered bacteria express a degradation resistant GLP-1 analog (see, e.g., Gallwitz et al., 2000). In some embodiments, the gene encoding GLP-1 or proglucagon is modified and/or mutated, e.g., to enhance stability, increase GLP-1 production, and/or increase metabolic disease attenuation potency. In some embodiments, the local production of GLP-1 induces insulin secretion and/or differentiation of insulin-secreting cells. In some embodiments, the local production of GLP-1 produces satiety in a subject and ameliorates obesity. In some embodiments, the genetically engineered bacteria are capable of expressing GLP-1 or proglucagon in low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose.

TABLE 8

| GLP-1 Polynucleotide Sequences | |
| --- | --- |
| Description | Sequence |
| GLP-1 (1-37), with initiation met codon; codon optimized for expression in E. coli. SEQ ID NO: 71 | ATGGACGAGTTCGAACGCCACG CGGAGGGAACTTTCACTTCTGA TGTTTCTAGCTATTTGGAGGGC CAGGCTGCGAAAGAGTTTATTG CTTGGCTGGTTAAAGGTCGTGG TTAA |
| GLP1 (1-37) codon optimized for expression in E. coli. SEQ ID NO: 72 | GACGAGTTCGAACGCCACGCGG AGGGAACTTTCACTTCTGATGT TTCTAGCTATTTGGAGGGCCAG GCTGCGAAAGAGTTTATTGCTT GGCTGGTTAAAGGTCGTGGTTAA |

TABLE 9

| GLP-1 Polypeptide Sequences | |
| --- | --- |
| Description | Sequence |
| GLP-1 (1-37) SEQ ID NO: 73 | HDEFERHAEGTFTSDVSSYLEGQAAKEFTAW LVKGRG |
| GLP-1 (1-37) H->M substitution SEQ ID NO: 74 | MDEFERHAEGTFTSDVSSYLEGQAAKEFTAW LVKGRG |
| GLP-1-(7-37) SEQ ID NO: 75 | HAEGTFTSDVSSYLEGQAAKEFIAWLVKGRG |
| GLP-1-(7-36)NH2 SEQ ID NO: 76 | HAEGTFTSDVSSYLEGQAAKEFIAWLVKGR |
| glocagon preproprotein (NP_002045.1) 1-20 is signal peptide SEQ ID NO: 77 | MKSIYFVAGLFVMLVQGSWQRSLQDTEEKSR SFSASQADPLSDPDQMNEDKRHSQGTFTSDY SKYLDSRRAQDFVQWLMNTKRNRNNIAKRHD EFERHAEGTFTSDVSSYLEGQAAKEFIAWLV KGRGRRDFPEEVAIVEELGRRHADGSFSDEM NTILDNLAARDFINWLIQTKITDRK |
| Proglucagon (Signal peptide 1-20; Glucagon-like peptide 1 (92-128); Glucagon-like peptide 2 146-178 SEQ ID NO: 78 | RSLQDTEEKSRSFSASQADPLSDPDQMNEDK RHSQGTFTSDYSKYLDSRRAQDFVQWLMNTK RNRNNIAKRHDEFERHAEGTFTSDVSSYLEG QAAKEFIAWLVKGRGRRDFPEEVAIVEELGR RHADGSFSDEMNTILDNLAARDFINWLIQTK ITDRK |
| Glucagon SEQ ID NO: 79 | HSQGTFTSDYSKYLDSRRAQDFVQWLMNT |
| Glicentin SEQ ID NO: 80 | RSLQDTEEKSRSFSASQADPLSDPDQMNEDK RHSQGTFTSDYSKYLDSRRAQDFVQWLMNTK RNRNNIA |
| Glicentin related peptide SEQ ID NO: 81 | RSLQDTEEKSRSFSASQADPLSDPDQMNED |

TABLE 9-continued

GLP-1 Polypeptide Sequences

| Description | Sequence |
| --- | --- |
| Oxyntomodulin<br>SEQ ID NO: 82 | HSQGTFTSDYSKYLDSRRAQDFVQWLMNTKR<br>NRNNIA |

The circulating active form of GLP-1 is GLP-1(7-37), which has a very short biological half-life of the order of just a few minutes in blood. The relatively low stability of GLP-1 (3-5 min) has significantly limited its clinical utility because of the rapid degradation catalyzed by the enzyme dipeptidyl peptidase IV (DPP-IV), but also other enzymes such as neutral endopeptidase (NEP), plasma kallikrein or plasmin. One strategy to prolong in vivo half-life is stabilization towards degradation by DPPIV, which preferably cleaves N-terminal Xaa-Pro or Xaa-Ala dipeptide sequences. Alteration of that N-terminal sequence, especially the second amino acid, has proven to reduce degradation by DPPIV (e.g., reviewed in Lorenz et al., Recent progress and future options in the development of GLP-1 receptor agonists for the treatment of diabesity; Bioorganic & Medicinal Chemistry Letters, 23 (14); 4011-4018). In some embodiments, the genetically engineered bacteria comprise a cassette encoding GLP-1 fragment or variant, in which the DPP-IV is mutated, such that it can no longer be cleaved by the enzyme.

GLP-1 is released in a tissue specific manner, though post-translational processing of pre-pro-glucagon, from the neuroendocrine L-cells predominantly in two forms, GLP-1 (7-36) amide, which constitutes approximately 80% of circulating GLP-1, and GLP-1 (7-37) amide. GLP-1 (1-36 amide) is predominantly secreted in the pancreas, whereas GLP-1 (1-37) is secreted in the ileum and hypothalamus.

In addition, full length GLP-1-(1-37) is produced in much smaller amounts. This full-length form of GLP-1(1-37), was previously thought to be inactive, but was found to stimulate rat intestinal epithelial cells to become glucose-responsive insulin-secreting cells, i.e., full length GLP-1 could convert intestinal epithelial progenitors in the small intestine into insulin-producing cells (Suzuki et al., Glucagon-like peptide 1 (1-37) converts intestinal epithelial cells into insulin-producing cells; Proc Natl Acad Sci USA. 2003 Apr. 29; 100(9): 5034-5039). While the amounts of GLP-1 (1-37) produced endogenously likely are not sufficient for these effects, secretion of large amounts of GLP-1, e.g., by the genetically engineered bacteria, are likely sufficient to alter a balance in the developmental environment of the intestinal epithelia, leading to the induction of insulin-producing cells from intestinal epithelial progenitors. As such, secretion of full-length GLP-1 by the genetically engineered bacteria of the disclosure is a novel therapeutic strategy for the treatment of a number of diseases related to dysregulation of insulin production and/or secretion, including diabetes.

GLP-1 analogs, which exhibit extended stability in serum, have become important in the clinic. Exendin-4, a peptide produced in the salivary glands of the Gila monster (Heloderma suspectum), possesses similar glucose regulatory function to the human GLP-1 peptide. In exendin-4, the second amino acid is a Gly rendering it resistant to DPPIV mediated degradation. Furthermore, the Leu21-Ser39 span of exendin-4 forms a compact tertiary fold (the Trp-cage) which shields the side chain of Trp25 from solvent exposure, leading to enhanced helicity and stability of the peptide (see Lorenz et al. for review). Exenatide BID is a synthetic version of exendin-4, represents the first GLP-1 RA approved in 2005 as antidiabetic therapy for the treatment of T2DM. Following the FDA approval of exendin-4, liraglutide and albiglutide, which are long-acting GLP-1 analogs using palmitic acid conjugation and albumin fusion, respectively, were approved. Many other strategies have also been employed to achieve long-acting activity of GLP-1, including dimerization, intra-molecular conjugation, and additional variant positive charged amino acids on the N terminus. Table 10 lists non-limiting examples of GLP-1R agonists. In some embodiments, the genetically engineered bacteria comprise a gene encoding Exenatide. In some embodiments, the genetically engineered bacteria comprise a gene encoding Liraglutide. In some embodiments, the genetically engineered bacteria comprise a gene encoding Lixisenatide. In some embodiments, the genetically engineered bacteria comprise a gene encoding Albiglutide. In some embodiments, the genetically engineered bacteria comprise a gene encoding Dulaglutide. In some embodiments, the genetically engineered bacteria comprise a gene encoding Taspoglutide. In some embodiments, the genetically engineered bacteria comprise a gene encoding Semaglutide.

TABLE 10

Non-limiting examples of GLP-1R agonists

| Name and SEQ ID NO | Sequence | Short description |
| --- | --- | --- |
| Exenatide<br>SEQ ID NO: 83 | HGEGTFTSDLSKQMEE<br>EAVRLFIEWLKNGGPS<br>SGAPPPS | Second amino acid is a Gly rendering it resistant to DPPIV mediated degradation. Furthermore, the Leu21-Ser39 span of exendin-4 forms a compact tertiary fold (the Trp-cage) which shields the side chain of Trp25 from solvent exposure, leading to enhanced helicity and stability of the peptide |

TABLE 10-continued

Non-limiting examples of GLP-1R agonists

| Name and SEQ ID NO | Sequence | Short description |
|---|---|---|
| Liraglutide SEQ ID NO: 84 | HAEGTFTSDVSSYLEG QAAKEEFIIAWLVKGRG | a close structural homolog to GLP-1(7-37) with 97% sequence identity to the native hormone. Lys in position 34 is substituted by Arg and a palmitic acid is conjugated to Lys in position 26 via a glutamate spacer |
| Lixisenatide SEQ ID NO: 85 | HGEGTFTSDLSKQMEE EAVRLFIEWLKNGGPS SGAPPSKKKKKK | synthetic analog of exendin-4. Compared to exendin-4, six Lys residues have been added to the C-terminus (also amidated), while one Pro in the C-terminal region has been deleted. |
| Albiglutide SEQ ID NO: 86 | HGEGTFTSDVSSYLEG QAAKEFIAWLVKGRH GEGTFTSDVSSYLEGQ AAKEFIAWLVKGRDA HKSEVAHRFKDLGEEN FKALVLIAFAQYLQQC PFEDHVKLVNEVTEFA KTCVADESAENCDKSL HTLFGDKLCTVATLRE TYGEMADCCAKQEPE RNECFLQHKDDNPNLP RLVRPEVDVMCTAFH DNEETFLKKYLYEIAR RHPYFYAPELLFFAKR YKAAFTECCQAADKA ACLLPKLDELRDEGKA SSAKQRLKCASLQKFG ERAFKAWAVARLSQR FPKAEFAEVSKLVTDL TKVHTECCHGDLLECA DDRADLAKYICENQDS ISSKLKECCEKPLLEKS HCIAEVENDEMPADLP SLAADFVESKDVCKN YAEAKDVFLGMFLYE YARRHPDYSVVLLLRL AKTYETTLEKCCAAA DPHECYAKVFDEFKPL VEEPQNLIKQNCELFE QLGEYKFQNALLVRY TKKVPQVSTPTLVEVS RNLGKVGSKCCKHPE AKRMPCAEDYLSVVL NQLCVLHEKTPVSDRV TKCCTESLVNRRPCFS ALEVDETYVPKEFNAE TFTFHADICTLSEKERQ IKKQTALVELVKHKPK ATKEQLKAVMDDFAA FVEKCCKADDKETCFA EEGKKLVAASQAALGL | two copies of GLP-1 are fused as tandem repeat to the N-terminus of albumin DPPIV-resistance is achieved by a single substitution, Ala for Gly, at the DPPIV cleavage site. |
| Dulaglutide SEQ ID NO: 87 | HGEGTFTSDVSSYLEE QAAKEFIAWLVKGGG GGGGSGGGGSGGGGS AESKYGPPCPPCPAPE AAGGPSVFLPPPKPKD TLMISRTPEVTCVVVD VSQEDPEVQFNWYVD GVEVHNAKTKPREEQF NSTYRVVSVLTVLHQD WLNGKEYKCKVSNKG LPSSIEKTISKAKGQPR EPQVYTLPPSQEEMTK NQVSLTCLVKGFYPSD IAVEWESNGQPENNYK TTPPVLDSDGSFFLYSR LTVDKSRWQEGNVFS | A recombinant fusion protein, which consists of two GLP-1 peptides covalently linked by a small peptide [tetraglycyl-1-seryltetraglycyl-1-seryltetraglycyl-1-seryl-1-alanyl] to a human IgG4-Fc heavy chain variant. Compared to natural GLP-1, the GLP-1 moieties contain amino acid substitutions (Ala8→Gly, Gly26→Glu, Arg36→Gly) to ensure protection from DPPIV cleavage as well as |

TABLE 10-continued

Non-limiting examples of GLP-1R agonists

| Name and SEQ ID NO | Sequence | Short description |
|---|---|---|
| | CSVMHEALHNHYTQK SLSLSLG | maintenance of the potency of the construct. |
| Taspoglutide SEQ ID NO: 88 | His-Aib-Glu-Gly-Thr-Phe-Thr-Ser-Asp-Val-Ser-Ser-Tyr-Leu-Glu-Gly-Gln-Ala-Ala-Lys-Glu-Phe-Ile-Ala-Trp-Leu-Val-Lys-Aib-Arg-NH$_2$ | a close analog of natural GLP-1(7-36) in which the unnatural amino acid aminoisobutyric acid (Aib) has been introduced in position 8 and 35 in order to avoid degradation by DPPIV, but also by other serine proteases such as plasma kallikrein and plasmin. |
| Semaglutide SEQ ID NO: 89 | MAGAPGPLRLALLLLG MVGRAGPRPQGATVS LWETVQKWREYRRQC QRSLTEDPPPATDLFC NRTFDEYACWPDGEP GSFVNVSCPWYLPWA SSVPQGHVYRFCTAEG LWLQKDNSSLPWRDL SECEESKRGERSSPEEQ LLFLYIIYTVGYALSFS ALVIASAILLGFRHLHC TRNYIHLNLFASFILRA LSVFIKDAALKWMYST AAQQHQWDGLLSYQD SLSCRLVFLLMQYCVA ANYYWLLVEGVYLYT LLAFSVLSEQWIFRLY VSIGWGVPLLFVVPWG IVKYLYEDEGCWTRNS NMNYWLIIRLPILFAIG VNFLIFVRVICIVVSKL KANLMCKTDIKCRLA KSTLTLIPLLGTHEVIF AFVMDEHARGTLRFIK LFTELSFTSFQGLMVAI LYCFVNNEVQLEFRKS WERWRLEHLHIQRDSS MKPLKCPTSSLSSGAT AGSSMYTATCQASCS | |

In one embodiment, GLP-1 and/or a GLP-1R agonist of Table 10 stimulates the rate of insulin secretion in the body. In one embodiment, GLP-1 and/or a GLP-1R agonist of Table 10 inhibits and lowers plasma glucose produced in the body. In one embodiment, GLP-1 and/or a GLP-1R agonist of Table 10 decreases the level of lipotoxic metabolites in the body. In one embodiment, GLP-1 and/or a GLP-1R agonist of Table 10 decreases the degree of pro-inflammatory substrate in the body. In one embodiment, GLP-1 decreases the level of insulin resistance (IR) in the body. In one embodiment, GLP-1 and/or a GLP-1R agonist of Table 10 decreases the level of hepatic lipid deposition in the body. Methods for measuring the insulin secretion rates and glucose levels are well known to one of ordinary skill in the art. For example, blood samples taken periodically, and standard statistical analysis methods may be used to determine the insulin secretion rates and plasma glucose levels in a subject.

GLP-1 and/or a GLP-1R agonist of Table 10 may be expressed or modified in bacteria of this disclosure in order to enhance insulin stimulation and reduce plasma glucose levels in subjects having liver disease, such as NASH. Specifically, when GLP-1 and/or a GLP-1R agonist of Table 10 is expressed in the engineered bacterial cells of the disclosure, the expressed GLP-1 and/or a GLP-1R agonist of Table 10 will reduce the degree of lipotoxic metabolites, pro-inflammatory substrate, and hepatic lipid deposition in the subject.

GLP-1 and/or a GLP-1R agonist of Table 10 may be expressed or modified in bacteria of this disclosure in order to enhance insulin stimulation and reduce plasma glucose levels in subjects having type two diabetes, obesity, and/or metabolic syndrome, or metabolic syndrome related disorders, including cardiovascular disorders, and obesity in a subject.

In one embodiment, the bacterial cell comprises one or more genes encoding a GLP-1 and/or a GLP-1R agonist of Table 10. In some embodiments, the disclosure provides a bacterial cell that comprises a heterologous gene encoding a glucagon-like peptide 1 operably linked to a first promoter. In one embodiment, the first promoter is an inducible promoter. In one embodiment, the bacterial cell comprises at least one, two, three, four, five, or six copies of a gene encoding a glucagon-like peptide 1. In one embodiment, the bacterial cell comprises multiple copies of a gene or genes encoding a glucagon-like peptide 1.

Multiple distinct embodiments of GLP-1 and/or a GLP-1R agonist of Table 10 are known in the art. In some embodiments, the glucagon-like peptide 1 is encoded by a gene derived from a bacterial species. In some embodiments, a glucagon-like peptide 1 is encoded by a gene derived from a non-bacterial species. In some embodiments, a glucagon-like peptide 1 is encoded by a gene derived from a eukaryotic species, e.g. *Homo sapiens*. In one embodiment, the gene encoding the glucagon-like peptide 1 is expressed in an organism of the genus or species that includes, but is not limited to, *Lactobacillus* spp., such as *Lactobacillus plantarum, Lactobacillus johnsonii, Lactobacillus acidophilus, Lactobacillus reuteri, Lactobacillus brevis*, or *Lactobacillus gasseri*; *Bifidobacterium* spp., such as *Bifidobacterium longum*; *Bacillus* spp., such as *Bacillus subtilis, Bacillus licheniformis, Bacillus lentus, Bacillus brevis, Bacillus stearothermophilus, Bacillus alkalophilus, Bacillus amyloliquefaciens, Bacillus coagulans, Bacillus circulans, Bacillus lautus*; and *Streptomyces* spp., such as *Streptomyces lividans*.

In one embodiment, the gene encoding the GLP-1 and/or a GLP-1R agonist of Table 10 has been codon-optimized for use in the engineered bacterial cell. In one embodiment, the gene encoding the glucagon-like peptide 1 has been codon-optimized for use in *Escherichia coli*. In another embodiment, the gene encoding the glucagon-like peptide 1 has been codon-optimized for use in *Lactococcus*. When the gene encoding the GLP-1 and/or a GLP-1R agonist of Table 10 is expressed in the engineered bacterial cells, the bacterial cells express more GLP-1 and/or a GLP-1R agonist of Table 10 than unmodified bacteria of the same bacterial subtype under the same conditions (e.g., culture or environmental conditions). Thus, the genetically engineered bacteria comprising a heterologous gene encoding a GLP-1 and/or a GLP-1R agonist of Table 10 may be used to express more GLP-1 and/or a GLP-1R agonist of Table 10 to treat liver disease, such as nonalcoholic steatohepatitis, type two diabetes, metabolic syndrome, and metabolic syndrome related disorders, including cardiovascular disorders and obesity in a subject.

Assays for testing the activity of a GLP-1 and/or a GLP-1R agonist of Table 10 or a glucagon-like peptide 1 receptor are well known to one of ordinary skill in the art. For example, glucose and insulin levels can be assessed by drawing plasma samples from subjects previously administered intravenous infusions of the glucagon-like peptide 1 as described in Kjems, et al., Diabetes, 52:380-386 (2003), the entire contents of which are expressly incorporated herein by reference. Briefly, plasma samples from a subject are treated with heparin and sodium fluoride, centrifuged, and plasma glucose levels measured by a glucose oxidase technique. Likewise, the plasma insulin concentrations are measured by a two-site insulin enzyme linked immunosorbent method. Alternatively, baby hamster kidney cells can be used to assay structure-activity relationships of glucagon-like peptide 1 derivatives (see, for example, Knudsen et al., J. Med. Chem., 43:1664-1669 (2000), the entire contents of which are expressly incorporated herein by reference). The present disclosure encompasses genes encoding a GLP-1 and/or a GLP-1R agonist of Table 10 comprising amino acids in its sequence that are substantially the same as an amino acid sequence described herein.

In some embodiments, the gene encoding a GLP-1 and/or a GLP-1R agonist of Table 10 is mutagenized; mutants exhibiting increased activity are selected; and the mutagenized gene encoding the GLP-1 and/or a GLP-1R agonist of Table 10 is isolated and inserted into the bacterial cell of the disclosure. The gene comprising the modifications described herein may be present on a plasmid or chromosome.

In one embodiment, the gene encoding the glucagon-like peptide 1 is from *Homo sapiens*. In one embodiment, the gene encoding the glucagon-like peptide 1 is from *Lactobacillus* spp. In one embodiment, the *Lacotbacillus* spp. is *Lactobacillus plantarum* WCFS 1, *Lactobacillus plantarum* 80, *Lactobacillus johnsonii* NCC533, *Lactobacillus johnsonii* 100-100, *Lactobacillus acidophilus* NCFM ATCC700396, *Lactobacillus brevis* ATCC 367, *Lactobacillus gasseri* ATCC 33323, or *Lactobacillus acidophilus*. In another embodiment, the gene encoding the glucagon-like peptide 1 is from a *Bifidobacterium* spp. In one embodiment, the *Bifidobacterium* spp. is *Bifidobacterium longum* NCC2705, *Bifidobacterium longum* DJO10A, *Bifidobacterium longum* BB536, or *Bifidobacterium longum* SBT2928. In another embodiment, the gene encoding the glucagon-like peptide 1 is from *Bacillus* spp. In one embodiment, the *Bacillus* spp is *Bacillus subtilis*, or *Bacillus licheniformis*, or *Bacillus lentus*, or *Bacillus brevis*, or *Bacillus stearothermophilus*, or *Bacillus alkalophilus*, or *Bacillus amyloliquefaciens*, or *Bacillus coagulans*, or *Bacillus circulans*, or *Bacillus lautus*. In another embodiment, the gene encoding the glucagon-like peptide 1 is from *Streptomyces* spp. In one embodiment, the *Streptomyces* spp. is *Streptomyces lividans*. Other genes encoding glucagon-like peptide 1 are well-known to one of ordinary skill in the art and described in, for example, MacDonald, et al., Diabetes, 51(supp. 3):S434-S442 (2002) and WO1995/017510.

In one embodiment, the gene encoding the glucagon-like peptide 1 has at least about 80% identity with a nucleic acid sequence encoding SEQ ID NO: 71 or SEQ ID NO: 72. In another embodiment, the gene encoding the glucagon-like peptide 1 has at least about 85% identity with a nucleic acid sequence encoding SEQ ID NO: 71 or SEQ ID NO: 72. In one embodiment, the gene encoding the glucagon-like peptide 1 has at least about 90% identity with a nucleic acid sequence encoding SEQ ID NO: 71 or SEQ ID NO: 72. In one embodiment, the gene encoding the glucagon-like peptide 1 has at least about 95% identity with a nucleic acid sequence encoding SEQ ID NO: 71 or SEQ ID NO: 72. In another embodiment, the gene encoding the glucagon-like peptide 1 has at least about 96%, 97%, 98%, or 99% identity with a nucleic acid sequence encoding SEQ ID NO: 71 or SEQ ID NO: 72. Accordingly, in one embodiment, the gene encoding the glucagon-like peptide 1 has at least about 80%, 81%, 82%, 83%, 84%, 85%, 86%, 87%, 88%, 89%, 90%, 91%, 92%, 93%, 94%, 95%, 96%, 97%, 98%, or 99% identity with a nucleic acid sequence encoding SEQ ID NO:40. In another embodiment, the gene encoding the glucagon-like peptide 1 comprises a nucleic acid sequence encoding SEQ ID NO: 71 or SEQ ID NO: 72. In yet another embodiment the gene encoding the glucagon-like peptide 1 consists of a nucleic acid sequence encoding SEQ ID NO: 71 or SEQ ID NO: 72.

In one embodiment, the gene encoding the glucagon-like peptide 1 is directly operably linked to a first promoter. In another embodiment, the gene encoding the glucagon-like peptide 1 is indirectly operably linked to a first promoter. In one embodiment, the promoter is not operably linked with the gene encoding the glucagon-like peptide 1 in nature.

In some embodiments, the gene encoding the glucagon-like peptide 1 is expressed under the control of a constitutive promoter. In another embodiment, the gene encoding the glucagon-like peptide 1 is expressed under the control of an inducible promoter. In some embodiments, the gene encoding the glucagon-like peptide 1 is expressed under the control of a promoter that is directly or indirectly induced by exogenous environmental conditions. In one embodiment, the gene encoding the glucagon-like peptide 1 is expressed under the control of a promoter that is directly or indirectly induced by low-oxygen or anaerobic conditions, wherein expression of the gene encoding the glucagon-like peptide 1 is activated under low-oxygen or anaerobic environments, such as the environment of the mammalian gut. In one embodiment, the gene encoding the glucagon-like peptide 1 is expressed under the control of a promoter that is directly or indirectly induced in the presence of certain molecules or metabolites, in the presence of molecules or metabolites associated with liver damage, inflammation or an inflammatory response, or in the presence of some other metabolite that may or may not be present in the gut, such as arabinose. Inducible promoters are described in more detail infra.

The gene encoding the glucagon-like peptide 1 may be present on a plasmid or chromosome in the bacterial cell. In one embodiment, the gene encoding the glucagon-like peptide 1 is located on a plasmid in the bacterial cell. In another embodiment, the gene encoding the glucagon-like peptide 1 is located in the chromosome of the bacterial cell. In yet another embodiment, a native copy of the gene encoding the glucagon-like peptide 1 is located in the chromosome of the bacterial cell, and a second gene encoding a second glucagon-like peptide 1 is located on a plasmid in the bacterial cell. In yet another embodiment, a native copy of the gene encoding the glucagon-like peptide 1 is located on a plasmid in the bacterial cell, and a second gene encoding a second glucagon-like peptide 1 is located on a plasmid in the bacterial cell. In yet another embodiment, a native copy of the gene encoding the glucagon-like peptide 1 is located in the chromosome of the bacterial cell, and a second gene encoding a second glucagon-like peptide 1 is located in the chromosome of the bacterial cell.

In some embodiments, the gene encoding the glucagon-like peptide 1 is expressed on a low-copy plasmid. In some embodiments, the gene encoding the glucagon-like peptide 1 is expressed on a high-copy plasmid. In some embodiments, the high-copy plasmid may be useful for increasing expression of the glucagon-like peptide 1, thereby reducing the degree of lipotoxic metabolites, pro-inflammatory substrate, and hepatic lipid deposition prevalent to those suffering from non-alcoholic steatohepatitis.

In one embodiment, the genetically engineered bacteria comprise a gene cassette encoding GLP-1 (1-37), or a functional fragment or variant thereof. In one embodiment, the genetically engineered bacteria comprise a gene cassette encoding SEQ ID NO: 73. In one embodiment, the genetically engineered bacteria comprise a gene cassette encoding GLP-1 (1-37) H→M substitution), or a functional fragment or variant thereof. In one embodiment, the genetically engineered bacteria comprise a gene cassette encoding SEQ ID NO: 74. In one embodiment, the genetically engineered bacteria comprise a gene cassette encoding GLP-1-(7-37), or a functional fragment or variant thereof. In one embodiment, the genetically engineered bacteria comprise a gene cassette encoding SEQ ID NO: 75. In one embodiment, the genetically engineered bacteria comprise a gene cassette encoding GLP-1-(7-36), or a functional fragment or variant thereof. In one embodiment, the genetically engineered bacteria comprise a gene cassette encoding SEQ ID NO: 76.

In one embodiment, the genetically engineered bacteria comprise a gene cassette encoding glucagon preproprotein (NP_002045.1), or a functional fragment or variant thereof. In one embodiment, the genetically engineered bacteria comprise a gene cassette encoding Proglucagon, or a functional fragment or variant thereof. In one embodiment, the genetically engineered bacteria comprise a gene cassette encoding SEQ ID NO: 78. In one embodiment, the genetically engineered bacteria comprise a gene cassette encoding Glucagon, or a functional fragment or variant thereof. In one embodiment, the genetically engineered bacteria comprise a gene cassette encoding SEQ ID NO: 79. In one embodiment, the genetically engineered bacteria comprise a gene cassette encoding Glicentin), or a functional fragment or variant thereof. In one embodiment, the genetically engineered bacteria comprise a gene cassette encoding SEQ ID NO: 80 In one embodiment, the genetically engineered bacteria comprise a gene cassette encoding Glicentin related peptide), or a functional fragment or variant thereof. In one embodiment, the genetically engineered bacteria comprise a gene cassette encoding SEQ ID NO: 81. In one embodiment, the genetically engineered bacteria comprise a gene cassette encoding Oxyntomodulin. In one embodiment, the genetically engineered bacteria comprise a gene cassette encoding SEQ ID NO: 82.

In one embodiment, one or more polypeptides encoded by the butyrate circuits and expressed by the genetically engineered bacteria have at least about 80% identity with one or more of SEQ ID NO: 73 through SEQ ID NO: 82. In another embodiment, one or more polypeptides encoded by the butyrate circuits and expressed by the genetically engineered bacteria have at least about 85% identity with one or more of SEQ ID NO: 73 through SEQ ID NO: 82. In one embodiment, one or more polypeptides encoded by the butyrate circuits and expressed by the genetically engineered bacteria have at least about 90% identity with one or more of SEQ ID NO: 73 through SEQ ID NO: 82. In one embodiment, one or more polypeptides encoded by the butyrate circuits and expressed by the genetically engineered bacteria have at least about 95% identity with one or more of SEQ ID NO: 73 through SEQ ID NO: 82. In another embodiment, one or more polypeptides encoded by the butyrate circuits and expressed by the genetically engineered bacteria have at least about 96%, 97%, 98%, or 99% identity with one or more of SEQ ID NO: 73 through SEQ ID NO: 82. Accordingly, in one embodiment, one or more polypeptides encoded by the butyrate circuits and expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 62 through SEQ ID NO: 70, and SEQ ID NO: 41. In another embodiment, one or more polypeptides encoded by the butyrate circuits and expressed by the genetically engineered bacteria one or more polypeptides encoded by the butyrate circuits and expressed by the genetically engineered bacteria comprise the sequence of with one or more of SEQ ID NO: 73 through SEQ ID NO: 82. In yet another embodiment one or more polypeptides encoded by the butyrate circuits and expressed by the genetically engineered bacteria consist of the sequence of with one or more of SEQ ID NO: 73 through SEQ ID NO: 82.

In embodiments, the pro-glucagon derived polypeptides, GLP-1 polypeptides, GLP-1 analogs described herein, and functional variants or fragments thereof are secreted. In some embodiments, the genetically engineered bacteria comprise one or more cassettes encoding pro-glucagon derived polypeptides, GLP-1 polypeptides, GLP-1 analogs, and/or functional variants or fragments and a secretion gene cassette and/or mutations generating a leaky phenotype. In some embodiments, a flagellar type III secretion pathway is used to secrete pro-glucagon derived polypeptides, GLP-1 polypeptides, and/or GLP-1 analogs described herein. In some embodiments, a Type V Autotransporter Secretion System is used to secrete pro-glucagon derived polypeptides, GLP-1 polypeptides, and/or GLP-1 analogs described herein. In some embodiments, a Hemolysin-based Secretion System is used to secrete the pro-glucagon derived polypeptides, GLP-1 polypeptides, and/or GLP-1 analogs described herein. In alternate embodiments, the genetically engineered bacteria expressing the pro-glucagon derived polypeptides, GLP-1 polypeptides, and/or GLP-1 analogs described herein further comprise a non-native single membrane-spanning secretion system. As described herein. In some embodiments, the engineered bacteria expressing the pro-glucagon derived polypeptides, GLP-1 polypeptides, and/or GLP-1 analogs described herein. have one or more deleted or mutated membrane genes to generate a leaky phenotype as described herein.

In one embodiment, the genetically engineered bacteria comprise a gene cassette encoding Exenatide, or a functional fragment or variant thereof. In one embodiment, the genetically engineered bacteria comprise a gene cassette encoding SEQ ID NO: 83.

In one embodiment, the genetically engineered bacteria comprise a gene cassette encoding Liraglutide, or a functional fragment or variant thereof. In one embodiment, the genetically engineered bacteria comprise a gene cassette encoding SEQ ID NO: 84. In one embodiment, the genetically engineered bacteria comprise a gene cassette encoding Lixisenatide, or a functional fragment or variant thereof. In one embodiment, the genetically engineered bacteria comprise a gene cassette encoding SEQ ID NO: 85. In one embodiment, the genetically engineered bacteria comprise a gene cassette encoding Albiglutide, or a functional fragment or variant thereof. In one embodiment, the genetically engineered bacteria comprise a gene cassette encoding SEQ ID NO: 86. In one embodiment, the genetically engineered bacteria comprise a gene cassette encoding Dulaglutide, or a functional fragment or variant thereof. In one embodiment, the genetically engineered bacteria comprise a gene cassette encoding SEQ ID NO: 87. In one embodiment, the genetically engineered bacteria comprise a gene cassette encoding Taspoglutide, or a functional fragment or variant thereof. In one embodiment, the genetically engineered bacteria comprise a gene cassette encoding SEQ ID NO: 88. In one embodiment, the genetically engineered bacteria comprise a gene cassette encoding Semaglutide, or a functional fragment or variant thereof. In one embodiment, the genetically engineered bacteria comprise a gene cassette encoding SEQ ID NO: 89.

In one embodiment, one or more polypeptides encoded by the and expressed by the genetically engineered bacteria have at least about 80% identity with one or more of SEQ ID NO: 83 through SEQ ID NO: 89. In another embodiment, one or more polypeptides encoded by the propionate circuits and expressed by the genetically engineered bacteria have at least about 85% identity with one or more of SEQ ID NO: 83 through SEQ ID NO: 89. In one embodiment, one or more polypeptides encoded by the propionate circuits and expressed by the genetically engineered bacteria have at least about 90% identity with one or more of SEQ ID NO: 83 through SEQ ID NO: 89. In one embodiment, one or more polypeptides encoded by the propionate circuits and expressed by the genetically engineered bacteria have at least about 95% identity with one or more of SEQ ID NO: 83 through SEQ ID NO: 89. In another embodiment, one or more polypeptides encoded by the propionate circuits and expressed by the genetically engineered bacteria have at least about 96%, 97%, 98%, or 99% identity with one or more of SEQ ID NO: 83 through SEQ ID NO: 89. Accordingly, in one embodiment, one or more polypeptides encoded by the propionate circuits and expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 83 through SEQ ID NO: 89. In another embodiment, one or more polypeptides encoded by the propionate circuits and expressed by the genetically engineered bacteria one or more polypeptides encoded by the propionate circuits and expressed by the genetically engineered bacteria comprise the sequence of with one or more of SEQ ID NO: 83 through SEQ ID NO: 89. In yet another embodiment one or more polypeptides encoded by the propionate circuits and expressed by the genetically engineered bacteria consist of the sequence of with one or more of SEQ ID NO: 83 through SEQ ID NO: 89.

GLP-2

In some embodiments, the genetically engineered bacteria of the invention are capable of producing GLP-2 or proglucagon. Glucagon-like peptide 2 (GLP-2) is produced by intestinal endocrine cells and stimulates intestinal growth and enhances gut barrier function (Yazbeck et al., 2009). Obesity is associated with systemic inflammation and intestinal permeability, and commensal bacteria that produce GLP-2 may ameliorate those symptoms of the metabolic disease (Musso et al., 2010). The genetically engineered bacteria may comprise any suitable gene encoding GLP-2 or proglucagon, e.g., human GLP-2 or proglucagon. In some embodiments, a protease inhibitor, e.g., an inhibitor of dipeptidyl peptidase, is also administered to decrease GLP-2 degradation. In some embodiments, the genetically engineered bacteria express a degradation resistant GLP-2 analog, e.g., Teduglutide (Yazbeck et al., 2009). In some embodiments, the gene encoding GLP-2 or proglucagon is modified and/or mutated, e.g., to enhance stability, increase GLP-2 production, and/or increase gut barrier enhancing potency. In some embodiments, the genetically engineered bacteria are capable of expressing GLP-2 or proglucagon in low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose.

Bile Salts

Bile salts (also called conjugated bile acids) are cholesterol derivatives synthesized in the liver which comprise a steroid ring component conjugated with either taurine (taurocholic acid; TCA) or glycine (glycochenodeoxycholic acid; GCDCA). Bile salts act as signaling molecules to regulate systemic endocrine functions, including triglyceride, cholesterol, and glucose homeostasis (Houten et al., *EMBO J.*, 25:1419-1425 (2006) and Watanabe et al., *Nature*, 439:484-489 (2006)). Specifically, bile acids trigger cellular farnesoid X receptor (FXR)- and G-protein coupled receptor (TGR4)-mediated host responses. Additionally, bile salts have been shown to facilitate lipid absorption and repress bacterial cell growth in the small intestine, thereby influencing both host metabolic pathways and the microflora present in the gut (Jones et al., *PNAS*, 105(36):13580-13585 (2008) and Ridlon et al., *J. Lipid Research*, 47(2):241-259 (2006)).

Bile salts are stored in the gallbladder and then subsequently released into the duodenum via the common bile duct. In the small intestine, microbial bile salt hydrolase (BSH) enzymes remove the glycine or taurine molecules, a process referred to as deconjugation, to produce the primary bile acids cholic acid (CA) and chenodeoxycholic acid (CDCA). In the gut, bile acids are reabsorbed within the terminal ileum, while non-reabsorbed bile acids enter the large intestine. Once in the large intestine, bile acids are amenable to further modification by microbial 7α-dehydroxylase enzymes to yield secondary bile acids, such as deoxycholic acid (DCA) and lithocholic acid (LCA) (Joyce et al., *Gut Microbes*, 5(5):669-674 (2014); Bhowmik et al., Accepted Article, doi:10.1002/prot.24971 (2015); see also FIG. 1).

It has been shown that bile salt metabolism is involved in host physiology (Ridlon et al., *Current Opinion Gastroenterol.*, 30(3):332 (2014) and Jones et al., 2008). For example, it is known that the expression of bile salt hydrolase enzymes functionally regulate host lipid metabolism and play a role in cholesterol metabolism and transport, circadian rhythm, gut homeostasis/barrier function, weight gain, adiposity, and possibly gastrointestinal cancers in the host (Joyce et al., *PNAS*, 111(20):7421-7426 (2014); Zhou and Hylemon, *Steroids*, 86:62-68, (2014); Mitchell et al., *Expert Opinion Biolog. Therapy*, 13(5):631-642 (2013); and WO14/198857, the entire contents of each of which are expressly incorporated herein by reference). Specifically, potential effects of bile salt hydrolase-expressing bacteria on cholesterol metabolic pathways have been shown to upregulate the ATP binding cassette A1 (ABCA1), the ATP binding cassette G1 (ABCG1), the ATP binding cassette G5/G8 (ABCG5/G8), cholesterol 7 alpha-hydroxylase (CYP7A1), and liver X receptor (LXR), and to downregulate farnesoid X receptor (FXR), Niemann-Pick C1-like 1 (NPC1L1), and small heterodimer partner (SHP), which impacts cholesterol efflux, plasma HDL-C levels, biliary excretion, cholesterol catabolism, bile acid synthesis, cholesterol levels, and decreased intestinal cholesterol absorption, among other effects (Mitchel et al. (2014) and Zhou and Hylemon (2014)). Additionally, bile salt hydrolase activity has been shown to impact bile detoxification, gastrointestinal persistence, nutrition, membrane alterations, altered digestive functions (lipid malabsorption, weight loss), cholesterol lowering, cancer, and formation of gallstones (see Begley et al., *Applied and Environmental Microbiology*, 72(3):1729-1738 (2006)). Moreover, a *Clostridium scindens* bacterium expressing a 7α-dehydroxylase enzyme has been shown to produce resistance to *C. difficile* infection in hosts (Buffie et al., *Nature*, 517:205-208 (2015), and bile salt metabolism has been shown to play a role in both regulating the microbiome as well as in cirrhosis (Ridlon et al., *Gut Microbes*, 4(5):382-387 (2013) and Kakiyama et al., *J. Hepatol.*, 58(5):949-955 (2013)). Thus, a need exists for treatments which address the metabolism of bile salts in subjects in order to treat and prevent diseases and disorders in which bile salts play a role, such as cardiovascular disease, metabolic disease, cirrhosis, gastrointestinal cancer, and *C. difficile* infection.

As used herein, the term "bile salt" or "conjugated bile acid" refers to a cholesterol derivative that is synthesized in the liver and consists of a steroid ring component that is conjugated with either glycine (glycochenodeoxycholic acid; GCDCA) or taurine (taurocholic acid; TCA). Bile salts are stored in the gallbladder and then subsequently released into the duodenum. Bile salts act as signaling molecules to regulate systemic endocrine functions including triglyceride, cholesterol, and glucose homeostasis, and also facilitate lipid absorption. In the small intestine, microbial bile salt hydrolase (BSH) enzymes remove the glycine or taurine molecules to produce bile acids.

As used herein, the term "bile acid" or "unconjugated bile acid" refers to cholic acid (CA) or chenodeoxycholic acid (CDCA). In the gut, bile acids are reabsorbed within the terminal ileum, while non-reabsorbed bile acids enter the large intestine. In the large intestine, bile acids are amenable to further modification by microbial 7α-dehydroxylase enzymes to yield secondary bile acids, such as deoxycholic acid (DCA) and lithocholic acid (LCA). As used herein, the term "catabolism" refers to the processing, breakdown and/or degradation of a metabolite or a complex molecule, such as tryptophan or a bile salt, into compounds that are non-toxic or which can be utilized by the bacterial cell or can be exported into the extracellular environment, where these compounds may function as effectors.

In one embodiment, the term "bile salt catabolism" refers to the processing, breakdown, and/or degradation of bile salts into unconjugated bile acid(s). In one embodiment, "abnormal catabolism" refers to any condition(s), disorder(s), disease(s), predisposition(s), and/or genetic mutations(s) that result in increased levels of bile salts. In one embodiment, "abnormal catabolism" refers to an inability and/or decreased capacity of a cell, organ, and/or system to process, degrade, and/or secrete bile salts. In healthy adult humans, 600 mg of bile salts are secreted daily. In one embodiment, said inability or decreased capacity of a cell, organ, and/or system to process and/or degrade bile salts is caused by the decreased endogenous deconjugation of bile salts, e.g., decreased endogenous deconjugation of bile salts into bile acids by the intestinal microbiota in the gut. In one embodiment, the inability or decreased capacity of a cell, organ, and/or system to process and/or degrade bile salts results from a decrease in the number of or activity of intestinal bile salt hydrolase (BSH)-producing microorganisms.

In one embodiment, a "disease associated with bile salts" or a "disorder associated with bile salts" is a disease or disorder involving the abnormal, e.g., increased, levels of bile salts in a subject. Alternatively, a disease or disorder associated with bile salts is a disease or disorder wherein a subject exhibits normal levels of bile salts, but wherein the subject would benefit from decreased levels of bile salts. Bile salts function to solubilize dietary fat and enable its absorption into host circulation, and healthy adult humans secrete about 600 mg of bile salts daily through the stool. Thus, decreasing increased levels of bile salts, or normal levels of bile salts, in a subject would result in less uptake of dietary fat, causing the subject's liver to pull cholesterol from systemic circulation as it attempts to synthesize more. Thus, in one embodiment, a subject having a disease or disorder associated with bile salts secretes about 600 mg of bile salts in their stool daily. In another embodiment, a subject having a disease or disorder associated with bile salts secretes more than 600 mg, 700 mg, 800 mg, 900 mg, or 1 g of bile salts in their stool daily. In one embodiment, a disease or disorder associated with bile salts is a cardiovascular disease. In another embodiment, a disease or disorder associated with bile salts is a metabolic disease. In another embodiment, a disease or disorder associated with bile salts is a liver disease, such as cirrhosis, nonalcoholic steatohepatitis (NASH), or progressive familialintrahepatic cholestasis type 2 (PFIC2).

As used herein, the terms "cardiovascular disease" or "cardiovascular disorder" are terms used to classify numerous conditions affecting the heart, heart valves, and vasculature (e.g., veins and arteries) of the body, and encompasses diseases and conditions including, but not limited to hypercholesterolemia, diabetic dyslipidemia, hypertension, arteriosclerosis, atherosclerosis, myocardial infarction, acute coronary syndrome, angina, congestive heart failure, aortic aneurysm, aortic dissection, iliac or femoral aneurysm, pulmonary embolism, primary hypertension, atrial fibrillation, stroke, transient ischemic attack, systolic dysfunction, diastolic dysfunction, myocarditis, atrial tachycardia, ventricular fibrillation, endocarditis, arteriopathy, vasculitis, atherosclerotic plaque, vulnerable plaque, acute coronary syndrome, acute ischemic attack, sudden cardiac death, peripheral vascular disease, coronary artery disease (CAD), peripheral artery disease (PAD), and cerebrovascular disease. As used herein, a subject having "hypercholesterolemia" may have a total cholesterol of greater than 4 mmol/L, and a low-density lipoprotein cholesterol (LDL) of greater than 3 mmol/L.

As used herein, the terms "metabolic disease" or "metabolic disorder" refer to diseases caused by lipid and cholesterol metabolic pathways that are regulated by or affected by bile salts and bile acids. For example, cholesterol metabolic diseases and disorders include diabetes (including Type 1 diabetes, Type 2 diabetes, and maturity onset diabetes of the young (MODY)), obesity, weight gain, gallstones, hypertriglyceridemia, hyperfattyacidemia, and hyperinsulinemia.

As used herein, the term "bile salt hydrolase" enzyme refers to an enzyme involved in the cleavage of the amino acid sidechain of glycol- or tauro-conjugated bile acids to generate unconjugated bile acids (FIG. 2). Bile salt hydrolase (BSH) enzymes are well known to those of skill in the art. For example, bile salt hydrolase activity has been detected in *Lactobacillus* spp., *Bifidobacterium* spp., *Enterococcus* spp., *Clostridum* spp., *Bacteroides* spp., *Methanobrevibacter* spp., and *Listeria* spp. See, for example, Begley et al., *Applied and Environmental Microbiology*, 72(3): 1729-1738 (2006); Jones et al., *Proc. Natl. Acad. Sci.*, 105(36):13580-13585 (2008); Ridlon et al., *J. Lipid Res.*, 47(2):241-259 (2006); and WO2014/198857, the entire contents of each of which are expressly incorporated herein by reference.

Bile Salt Hydrolases

The bacterial cells described herein comprise a heterologous gene encoding a bile salt hydrolase enzyme and are capable of deconjugating bile salts into unconjugated bile acids (see FIGS. 1 and 2).

In one embodiment, the bile salt hydrolase enzyme increases the rate of bile salt catabolism in the cell. In one embodiment, the bile salt hydrolase enzyme decreases the level of bile salts in the cell or in the subject. In one embodiment, the bile salt hydrolase enzyme decreases the level of taurocholic acid (TCA) in the cell or in the subject. In one embodiment, the bile salt hydrolase enzyme decreases the level of glycochenodeoxycholic acid (GCDCA) in the cell or in the subject. Methods for measuring the rate of bile salt catabolism and the level of bile salts and bile acids are well known to one of ordinary skill in the art. For example, bile salts and acids may be extracted from a sample, and standard LC/MS methods may be used to determine the rate of bile salt catabolism and/or level of bile salts and bile acids.

In another embodiment, the bile salt hydrolase enzyme increases the level of bile acids in the cell or in the subject as compared to the level of bile salts in the cell or in the subject. In another embodiment, the bile salt hydrolase enzyme increases the level of cholic acid (CA) in the cell. In another embodiment, the bile salt hydrolase enzyme increases the level of chenodeoxycholic acid (CDCA) in the cell.

Enzymes involved in the catabolism of bile salts may be expressed or modified in the bacteria of the disclosure in order to enhance catabolism of bile salts. Specifically, when a bile salt hydrolase enzyme is expressed in the recombinant bacterial cells of the disclosure, the bacterial cells convert more bile salts into unconjugated bile acids when the bile salt hydrolase enzyme is expressed than unmodified bacteria of the same bacterial subtype under the same conditions. In another embodiment, when a bile salt hydrolase enzyme is expressed in the recombinant bacterial cells of the disclosure, the bacterial cells convert more bile salts, such as TCA or GCDCA, into CA and CDCA when the bile salt hydrolase enzyme is expressed than unmodified bacteria of the same bacterial subtype under the same conditions. Thus, the genetically engineered bacteria comprising a heterologous gene encoding a bile salt hydrolase enzyme can catabolize bile salts to treat disorders associated with bile salts, including cardiovascular diseases, metabolic diseases, liver disease, such as cirrhosis or NASH, gastrointestinal cancers, and *C. difficile* infection.

In one embodiment, the bacterial cell comprises a heterologous gene encoding a bile salt hydrolase enzyme. In some embodiments, the disclosure provides a bacterial cell that comprises a heterologous gene encoding a bile salt hydrolase enzyme operably linked to a first promoter. In one embodiment, the first promoter is an inducible promoter. In one embodiment, the bacterial cell comprises a gene encoding a bile salt hydrolase enzyme from a different organism, e.g., a different species of bacteria. In another embodiment, the bacterial cell comprises more than one copy of a native gene encoding a bile salt hydrolase enzyme. In yet another embodiment, the bacterial cell comprises at least one native gene encoding a bile salt hydrolase enzyme, as well as at least one copy of a gene encoding a bile salt hydrolase enzyme from a different organism, e.g., a different species of bacteria. In one embodiment, the bacterial cell comprises at least one, two, three, four, five, or six copies of a gene encoding a bile salt hydrolase enzyme. In one embodiment, the bacterial cell comprises multiple copies of a gene or genes encoding a bile salt hydrolase enzyme.

Multiple distinct bile salt hydrolase enzymes are known in the art. In some embodiments, bile salt hydrolase enzyme is encoded by a gene encoding a bile salt hydrolase enzyme derived from a bacterial species. In some embodiments, a bile salt hydrolase enzyme is encoded by a gene encoding a bile salt hydrolase enzyme derived from a non-bacterial species. In some embodiments, a bile salt hydrolase enzyme is encoded by a gene derived from a eukaryotic species, e.g., a fungi. In one embodiment, the gene encoding the bile salt hydrolase enzyme is derived from an organism of the genus or species that includes, but is not limited to, *Lactobacillus* spp., such as *Lactobacillus plantarum, Lactobacillus johnsonii, Lactobacillus acidophilus, Lactobacillus brevis*, or *Lactobacillus gasseri; Bifidobacterium* spp., such as *Bifidobacterium longum, Bifidobacterium bifidum*, or *Bifidobacterium adolescentis; Bacteroides* spp., such as *Bacteroides fragilis* or *Bacteroides vlugatus; Clostridium* spp., such as *Clostridium perfringens; Listeria* spp., such as *Listeria monocytogenes, Enterococcus* spp., such as *Enterococcus faecium* or *Enterococcusfaecalis; Brucella* spp., such as *Brucella abortus; Methanobrevibacter* spp., such as *Methanobrevibacter smithii, Staphylococcus* spp., such as *Staphylococcus aureus, Mycobacterium* spp., such as *Mycobacterium tuberculosis; Salmonella* spp., such as *Salmonella enterica; Listeria* spp., such as *Listeria monocytogenes*.

In one embodiment, the gene encoding the bile salt hydrolase enzyme has been codon-optimized for use in the recombinant bacterial cell. In one embodiment, the gene encoding the bile salt hydrolase enzyme has been codon-optimized for use in *Escherichia coli*. In another embodiment, the gene encoding the bile salt hydrolase enzyme has been codon-optimized for use in *Lactococcus*. When the gene encoding the bile salt hydrolase enzyme is expressed in the recombinant bacterial cells, the bacterial cells catabolize more bile salt than unmodified bacteria of the same bacterial subtype under the same conditions (e.g., culture or environmental conditions). Thus, the genetically engineered bacteria comprising a heterologous gene encoding a bile salt hydrolase enzyme may be used to catabolize excess bile salts to treat a disorder associated with bile salts, such as cardiovascular disease, metabolic disease, liver disease, such as cirrhosis or NASH.

The present disclosure further comprises genes encoding functional fragments of a bile salt hydrolase enzyme or functional variants of a bile salt hydrolase enzyme. As used herein, the term "functional fragment thereof" or "functional variant thereof" of a bile salt hydrolase enzyme relates to an element having qualitative biological activity in common with the wild-type bile salt hydrolase enzyme from which the fragment or variant was derived. For example, a functional fragment or a functional variant of a mutated bile salt hydrolase enzyme is one which retains essentially the same ability to catabolize bile salts as the bile salt hydrolase enzyme from which the functional fragment or functional variant was derived. For example, a polypeptide having bile salt hydrolase enzyme activity may be truncated at the N-terminus or C-terminus and the retention of bile salt hydrolase enzyme activity assessed using assays known to those of skill in the art, including the exemplary assays provided herein. In one embodiment, the recombinant bacterial cell comprises a heterologous gene encoding a bile salt hydrolase enzyme functional variant. In another embodiment, the recombinant bacterial cell comprises a heterologous gene encoding a bile salt hydrolase enzyme functional fragment.

Assays for testing the activity of a bile salt hydrolase enzyme, a bile salt hydrolase enzyme functional variant, or a bile salt hydrolase enzyme functional fragment are well known to one of ordinary skill in the art. For example, bile salt catabolism can be assessed by expressing the protein, functional variant, or fragment thereof, in a recombinant bacterial cell that lacks endogenous bile salt hydrolase enzyme activity. Bile salt hydrolase activity can be assessed using a plate assay as described in Dashkevicz and Feighner, *Applied Environ. Microbiol.*, 55:11-16 (1989) and Christiaens et al., *Appl. Environ. Microbiol.*, 58:3792-3798 (1992), the entire contents of each of which are expressly incorporated herein by reference. Briefly, bacterial cultures that are grown overnight can be spotted onto LB bile agar supplemented with either 0.5% (wt/vol) TDCA, 0.5% (wt/vol) GDCA, or 3% (vol/vol) human bile. BSH activity can be indicated by halos of precipitated deconjugated bile acids (see, also, Jones et al., *PNAS*, 105(36):13580-13585 (2008), the entire contents of which are expressly incorporated herein by reference). A ninhydrine assay for free taurine has also been described (see, for example, Clarke et al., *Gut Microbes*, 3(3):186-202 (2012), the entire contents of which are expressly incorporated herein by reference. Alternatively, a mouse model can be used to assay bile salt and bile acid signatures in vivo (see, for example, Joyce et al., *PNAS*, 111(20):7421-7426 (2014), the entire contents of which are expressly incorporated herein by reference). The present disclosure encompasses genes encoding a bile salt hydrolase enzyme comprising amino acids in its sequence that are substantially the same as an amino acid sequence described herein.

In some embodiments, the gene encoding a bile salt hydrolase enzyme is mutagenized; mutants exhibiting increased activity are selected; and the mutagenized gene encoding the bile salt hydrolase enzyme is isolated and inserted into the bacterial cell of the disclosure. The gene comprising the modifications described herein may be present on a plasmid or chromosome.

In one embodiment, the gene encoding the bile salt hydrolase enzyme is from *Lactobacillus* spp. In one embodiment, the *Lacotbacillus* spp. is *Lactobacillus plantarum* WCFS 1, *Lactobacillus plantarum* 80, *Lactobacillus johnsonii* NCC533, *Lactobacillus johnsonii* 100-100, *Lactobacillus acidophilus* NCFM ATCC700396, *Lactobacillus brevis* ATCC 367, *Lactobacillus gasseri* ATCC 33323, or *Lactobacillus acidophilus*. In another embodiment, the gene encoding the bile salt hydrolase enzyme is from a *Bifidobacterium* spp. In one embodiment, the *Bifidobacterium* spp. is *Bifidobacterium longum* NCC2705, *Bifidobacterium longum* DJO10A, *Bifidobacterium longum* BB536, *Bifidobacterium longum* SBT2928, *Bifidobacterium bifidum* ATCC 11863, or *Bifidobacterium adolescentis*. In another embodiment, the gene encoding the bile salt hydrolase enzyme is from *Bacteroides* spp. In one embodiment, the *Bacteroides* spp. is *Bacteroides fragilis* or *Bacteroides vlugatus*. In another embodiment, the gene encoding the bile salt hydrolase enzyme is from *Clostridium* spp. In one embodiment, the *Clostridum* spp. is *Clostridum perfringens* MCV 185 or *Clostridum perfringens* 13. In another embodiment, the gene encoding the bile salt hydrolase enzyme is from *Listeria* spp. In one embodiment, the *Listeria* spp. is *Listeria monocytogenes*. In one embodiment, the gene encoding the bile salt hydrolase enzyme is from *Methanobrevibacter* spp. In one embodiment, the *Methanobrevibacter* spp. is *Methanobrevibacter smithii*. Other genes encoding bile salt hydrolase enzymes are well-known to one of ordinary skill in the art and described in, for example, Jones et al., *PNAS*, 105(36):13580-13585 (2008) and WO2014/198857. Table 11 lists non-limiting examples of bile salt hydrolases.

TABLE 11

Bile Salt Hydrolases

| Gene or Operon | Sequence |
| --- | --- |
| Bile salt hydrolase from *Lactobacillus plantarum* SEQ ID NO: 90 | ATGTGTACTGCCATAACTTATCAATCTTATAATAATTACTTC GGTAGAAATTTCGATTATGAAATTTCATACAATGAAATGTT ACGATTACGCCTAGAAAATATCCACTAGTATTTCGTAAGGTG GAGAACTTAGATCACCATTATGCAATAATTGGAATTACTGCT GATGTAGAAAGCTATCCACTTTACTACGATGCGATGAATGAA AAAGGCTTGTGTATTGCGGGATTAAATTTTGCAGGTTATGCT GATTATAAAAAATATGATGCTGATAAAGTTAATATCACACCA TTTGAATTAATTCCTTGGTTATTGGGACAATTTTCAAGTGTT AGAGAAGTGAAAAAGAACATACAAAAACTAAACTTGGTTAAT ATTAATTTTAGTGAACAATTACCATTATCACCGCTACATTGG |

TABLE 11-continued

Bile Salt Hydrolases

| Gene or Operon | Sequence |
|---|---|
| | TTGGTTGCTGATAAACAGGAATCGATAGTTATTGAAAGTGTC<br>AAAGAAGGACTAAAAATTTACGACAATCCAGTAGGTGTGTTA<br>ACAAACAATCCTAATTTTGACTACCAATTATTTAATTTGAAC<br>AACTATCGTGCCTTATCAAATAGCACACCCCAAAATAGTTTT<br>TCGGAAAAAGTGGATTTAGATAGTTATAGTAGAGGAATGGGC<br>GGACTAGGATTACCTGGAGACTTGTCCTCAATGTCTAGATTT<br>GTCAGAGCCGCTTTTACTAAATTAAACTCGTTGTCGATGCAG<br>ACAGAGAGTGGCAGTGTTAGTCAGTTTTTCCATATACTAGGG<br>TCTGTAGAACAACAAAAAGGGCTATGTGAAGTTACTGACGGA<br>AAGTACGAATATACAATCTATTCTTCTTGTTGTGATATGGAC<br>AAAGGAGTTTATTACTATAGAACTTATGACAATAGTCAAATT<br>AACAGTGTCAGTTTAAACCATGAGCACTTGGATACGACTGAA<br>TTAATTTCTTATCCATTACGATCAGAAGCACAATACTATGCA<br>GTTAACTAA |
| Bile salt hydrolase protein from Lactobacillus plantarum SEQ ID NO: 91 | MCTAITYQSYNNYFGRNFDYEISYNEMVTITPRKYPLVFRKV<br>ENLDHHYAIIGITADVESYPLYYDAMNEKGLCIAGLNFAGYA<br>DYKKYDADKVNITPFELIPWLLGQFSSVREVKKNIQKLNLVN<br>INFSEQLPLSPLHWLVADKQESIVIESVKEGLKIYDNPVGVL<br>TNNPNFDYQLFNLNNYRALSNSTPQNSFSEKVDLDSYSRGMG<br>GLGLPGDLSSMSRFVRAAFTKLNSLSMQTESGSVSQFFHILG<br>SVEQQKGLCEVTDGKYEYTIYSSCCDMDKGVYYYRTYDNSQI<br>NSVSLNHEHLDTTELISYPLRSEAQYYAVN |
| Bile salt hydrolase from Methanobrevibacter smithii 3142 SEQ ID NO: 92 | ATGTGTACTGCTGCAAATTATTTAACAAAATGCCATTATTTT<br>GGCCGTAATTTTGACTATGAAATTTCATATAATGAAAGAGTA<br>ACGATAACTCCTAGAAACTATCCTTTAATATTCAGGGATACT<br>GAGGACATTGAAAATCATTATGGGATTATTGGCATAGCTGCA<br>GGTATTGATGAATATCCTTTGTATTATGATGCATGTAATGAG<br>AAAGGATTAGCTATGGGGGGATTAAACTTTCCGGATTACTGT<br>GACTACAAACCACTAGATAAATCTAAAGTTAACATAGCTTCT<br>TTTGAGATTATTCCATATATATTATCTCAAGCAAAAACCATC<br>AGTGATGCCGAAAGGTTATTGGAAAACTTAAATATTTCAGAT<br>GAGAAATTTTCCGCCCAGTTGCCTCCATCTCCACTTCATTGG<br>ATTATTTCAGATAGGAATGCTTCAATTGTTGTAGAGGTTGTA<br>GAGGAAGGACTGGATATTTATGATAATCCTGTAGGAGTTTTA<br>ACAAACAACCCTCCTTTTGATAAACAGCTATTTAATTTAAAT<br>AATTATATGGCATTATCAAACAGAACGCCTGAAAATACCTTT<br>GGAGGCAATTTGGATTTGGCAACTTATAGTCGGGGAATGGGT<br>TCAATTGGTCTTCCGGGGGATGTTTCTTCACAGTCCCGTTTT<br>GTAAAAGCAGCTTTTGTTAAAGAAAATTCCGTTTCCGGAGAT<br>TCTGAAAAAGAAAGTGTGTCTCAGTTTTTCCATATTCTGGCA<br>TCTGTTGAACAGCAAAAAGGATGTACGTTAGTGGAAGAACCT<br>GATAAATTTGAGTATACTATTTATTCAGACTGTTACAATACA<br>GATAAGGGAATATTGTATTATAAAACATATGATGGTCCTCAA<br>ACATCTGTTAATATACATGATGAGGATTTGGAAACCAATCAG<br>TTAATTAATTTTGAGTTGGTTGATTAA |
| Bile salt hydrolase protein from Methanobrevibacter smithii 3142 SEQ ID NO: 93 | MCTAANYLTKCHYFGRNFDYEISYNERVTITPRNYPLIFRDT<br>EDIENHYGIIGIAAGIDEYPLYYDACNEKGLAMGGLNFPDYC<br>DYKPLDKSKVNIASFEIIPYILSQAKTISDAERLLENLNISD<br>EKFSAQLPPSPLHWIISDRNASIVVEVVEEGLDIYDNPVGVL<br>TNNPPFDKQLFNLNNYMALSNRTPENTFGGNLDLATYSRGMG<br>SIGLPGDVSSQSRFVKAAFVKENSVSGDSEKESVSQFFHILA<br>SVEQQKGCTLVEEPDKFEYTIYSDCYNTDKGILYYKTYDGPQ<br>TSVNIHDEDLETNQLINFELVD |
| Bile salt hydrolase from Bacteroides vulgatus SEQ ID NO: 94 | ATGGTTATGAAAAAGATTTTGATAGCTTTGGCCTTATTGCTG<br>ACAGGCATTGCAAGCGGATCGGCATGTACCGGTATTTCATTC<br>CTCGCTGAAGATGGCGGATATGTGCAGGCACGTACTATAGAG<br>TGGGGGAACAGTTATCTTCCGAGTGAATATGTTATTGTTCCC<br>AGAGGACAGGATTTGGTATCTTATACTCCAACGGGTGTAAAT<br>GGCTTGAGATTTCGGGCTAAATATGGTCTGGTAGGACTGGCT<br>ATCATTCAGAAAGAGTTTGTGGCTGAAGGACTGAATGAAGTA<br>GGGCTTTCGGCTGGATTGTTTATTTTCCCCATTATGGGAAG<br>TATGAAGAATATGATGAGGCTCAAAATGCAATTACTTTGTCG<br>GATTTGCAGGTGGTGAACTGGATGCTTTCCCAATTTGCTACT<br>ATAGACGAAGTGAGAGAAGCTATAGAAGGGGTGAAGGTGGTG<br>TCTCTTGATAAACCTGGTAAAGTTCTACGGTACATTGGCGC<br>ATTGGCGATGCTAAAGGAAATCAAATGGTGTTGGAATTTGTA<br>GGTGGTGTTCCTTATTTTTATGAAAATAAAGTAGGAGTACTC<br>ACCAATTCTCCCGATTTTCCATGGCAGGTGATTAACTTGAAT<br>AATTATGTAAATCTATATCCGGGAGCTGTCACTCCACAGCAA<br>TGGGGTGGGGTGACTATTTTCCCTTTTGGCGCAGGTGCCGGA<br>TTTCATGGTATTCCGGGGGATGTAACTCCTCCATCCCGTTTT<br>GTTCGTGTAGCGTTTTATAAGGCAACAGCTCCGGTGTGTCCT |

TABLE 11-continued

Bile Salt Hydrolases

| Gene or Operon | Sequence |
| --- | --- |
| | ACAGCGTATGACGCTATATTACAAAGCTTTCATATCCTGAAT<br>AATTTTGATATTCCTATTGGTATAGAATATGCGTTAGGGAAA<br>GCACCTGATATTCCTAGTGCCACACAATGGACTTCGGCTATT<br>GATTTGACAAACAGGAAAGTGTATTATAAAACAGCATACAAT<br>AACAATATTCGTTGTATTAGTATGAAGAAGATTGATTTTGAT<br>AAAGTGAAGTATCAGTCGTATCCATTGGATAAGGAGTTGAAA<br>CAGCCTGTAGAAGAGATTATTGTGAAATAG |
| Bile salt hydrolase<br>protein from<br>*Bacteroides*<br>*vulgatus*<br>SEQ ID NO: 95 | MVMKKILIALALLLTGIASGSACTGISFLAEDGGYVQARTIE<br>WGNSYLPSEYVIVPRGQDLVSYTPTGVNGLRFRAKYGLVGLA<br>IIQKEFVAEGLNEVGLSAGLFYFPHYGKYEEYDEAQNAITLS<br>DLQVVNWMLSQFATIDEVREAIEGVKVVSLDKPGKSSTVHWR<br>IGDAKGNQMVLEFVGGVPYFYENKVGVLTNSPDFPWQVINLN<br>NYVNLYPGAVTPQQWGGVTIFPFGAGAGFHGIPGDVTPPSRF<br>VRVAFYKATAPVCPTAYDAILQSFHILNNFDIPIGIEYALGK<br>APDIPSATQWTSAIDLTNRKVYYKTAYNNNIRCISMKKIDFD<br>KVKYQSYPLDKELKQPVEEIIVK |
| Bile salt hydrolase<br>from<br>*Bifidobacterium*<br>*longum*<br>SEQ ID NO: 96 | ATGTGCACTGGTGTCCGTTTCTCCGATGATGAGGGCAACAC<br>CTATTTCGGCCGTAATCTCGACTGGAGTTTCTCATATGGGG<br>AGACCATCCTGGTTACTCCGCGCGGCTACCACTATGACACG<br>GTGTTTGGTGCGGGCGGCAAGGCGAAGCCGAACGCGGTGAT<br>CGGCGTGGGTGTGGTCATGGCCGATAGGCCGATGTATTTCG<br>ACTGCGCCAATGAACATGGTCTGGCCATCGCCGGCTTGAAT<br>TTCCCCGGCTACGCCTCGTTCGTCCACGAACCGGTCGAAGG<br>CACGGAAAACGTCGCCACGTTCGAATTTCCGCTGTGGGTGG<br>CGCGTAATTTCGACTCCGTCGACGAGGTCGAGGAGGCGCTC<br>AGGAACGTGACGCTCGTCTCCCAGATCGTGCCGGGACAGCA<br>GGAGTCTCTGCTGCACTGGTTCATCGGCGACGGCAAGCGCA<br>GCATCGTCGTCGAGCAGATGGCCGATGGCATGCACGTGCAT<br>CATGATGACGTCGATGTGCTGACCAATCAGCCGACGTTCGA<br>CTTCCATATGGAAAACCTGCGCAACTACATGTGCGTCAGCA<br>ACGAGATGGCCGAACCGACTTCATGGGGCAAGGCCTCCTTG<br>ACCGCCTGGGGTGCGGGTGTGGGCATGCATGGCATCCCGGG<br>CGACGTGAGTTCCCCGTCGCGCTTCGTTCGTGTGGCCTACA<br>CCAACGCGCATTACCCGCAGCAGAACGATGAAGCCGCCAAT<br>GTGTCGCGCCTGTTCCACACCCTCGGCTCCGTGCAGATGGT<br>GGACGGCATGGCGAAGATGGGCGACGGCCAGTTCGAACGCA<br>CGCTGTTCACCAGCGGATATTCGTCCAAGACCAACACCTAT<br>TACATGAACACCTATGATGACCCCGCCATCCGTTCCTACGC<br>CATGGCCGATTACGATATGGATTCCTCGGAGCTCATCAGCG<br>TCGCCCGATGA |
| Bile salt hydrolase<br>protein from<br>*Bifidobacterium*<br>*longum*<br>SEQ ID NO: 97 | MCTGVRFSDDEGNTYFGRNLDWSFSYGETILVTPRGYHYDTV<br>FGAGGKAKPNAVIGVGVVMADRPMYFDCANEHGLAIAGLNFP<br>GYASFVHEPVEGTENVATFEFPLWVARNFDSVDEVEEALRNV<br>TLVSQIVPGQQESLLHWFIGDGKRSIVVEQMADGMHVHHDDV<br>DVLTNQPTFDPHMENLRNYMCVSNEMAEPTSWGKASLTAWGA<br>GVGMHGIPGDVSSPSRFVRVAYTNAHYPQQNDEAANVSRLFH<br>TLGSVQMVDGMAKMGDGQFERTLFTSGYSSKTNTYYMNTYDD<br>PAIRSYAMADYDMDSSELISVAR |
| Bile salt hydrolase<br>from *Listeria*<br>*monocytogenes*<br>SEQ ID NO: 98 | ATGTGTACGTCAATAACTTATACAACGAAGGATCACTATTT<br>TGGAAGGAATTTCGATTATGAACTTTCTTACAAAGAAGTTG<br>TGGTTGTTACGCCGAAAAATTACCCGTTCCATTTTCGCAAG<br>GTAGAGGATATAGAGAAGCATTATGCACTTATTGGTATTGC<br>TGCTGTGATGGAAAACTACCCGTTGTATTACGATGCTACCA<br>ATGAAAAAGGCCTTAGTATGGCAGGACTCAATTTCTCAGGA<br>AATGCGGATTACAAGGATTTTGCAGAAGGTAAGGACAATGT<br>GACCCCCTTTGAATTTATTCCGTGGATTCTTGGTCAATGCG<br>CTACTGTAAAAGAAGCAAGAAGATTACTTCAGAGAATCAAT<br>CTCGTGAATATTAGTTTTAGTGAAAATTTACCGCTGTCTCC<br>ATTACATTGGTTGATGGCTGATCAAACAGAATCTATTGTAG<br>TGGAATGTGTGAAAGATGGACTTCACATTTATGATAATCCT<br>GTTGGCGTGTTAACAAATAATCCAACATTTGATTACCAACT<br>ATTTAATTTAAACAATTATCGCGTTCTTTCGAGTGAAACCC<br>CAGAAAATAATTTTTCCAAAGAGATTGATTTGGATGCTTAT<br>AGTCGTGGGATGGGCGGAATTGGCTTACCTGGTGATTTATC<br>TTCTATGTCTCGTTTTGTGAAAGCAACTTTTACCAAATTGA<br>ATTCTGTTTCAGGTGATTCTGAATCAGAAAGTATTAGCCAA<br>TTTTTCCATATTTTAGGCTCGGTGGAACAACAAAAAGGTCT<br>TTGTGATGTTGGTGGGGGAAAATACGAGCATACTATTTATT<br>CCTCGTGTTGCAATATCGATAAAGGAATTTATTATTATAGA<br>ACATACGGAAACAGTCAAATTACTGGTGTGGATATGCACCA<br>AGAGGATTTAGAGAGCAAAGAACTAGCTATTTATCCACTCG<br>TCAATGAGCAACGACTAAACATTGTTAACAAATAA |

TABLE 11-continued

Bile Salt Hydrolases

| Gene or Operon | Sequence |
|---|---|
| Bile salt hydrolase protein from *Listeria monocytogenes* SEQ ID NO: 99 | MCTSITYTTKDHYFGRNFDYELSYKEVVVVTPKNYPFHFRKV EDIEKHYALIGIAAVMENYPLYYDATNEKGLSMAGLNFSGNA DYKDFAEGKDNVTPFEFIPWILGQCATVKEARRLLQRINLVN ISFSENLPLSPLHWLMADQTESIVVECVKDGLHIYDNPVGVL TNNPTFDYQLFNLNNYRVLSSETPENNFSKEIDLDAYSRGMG GIGLPGDLSSMSRFVKATFTKLNSVSGDSESESISQFFHILG SVEQQKGLCDVGGGKYEHTIYSSCCNIDKGIYYYRTYGNSQI TGVDMHQEDLESKELAIYPLVNEQRLNIVNK |
| Bile salt hydrolase from *Clostridium perfringens* SEQ ID NO: 100 | ATGTGTACAGGATTAGCCTTAGAAACAAAAGATGGATTACAT TTGTTTGGAAGAAATATGGATATTGAATATTCATTTAATCAA TCTATTATATTTATTCCTAGGAATTTTAAATGTGTAAACAAA TCAAACAAAAAAGAATTAACAACAAAATATGCTGTTCTTGGA ATGGGAACTATTTTTGATGATTATCCTACCTTTGCAGATGGT ATGAATGAAAAGGGATTAGGGTGTGCTGGCTTAAATTTCCCT GTTTATGTTAGCTATTCTAAAGAAGATATAGAAGGTAAAACT AATATTCCAGTATATAATTTCTTATTATGGGTTTTAGCTAAT TTTAGCTCAGTAGAAGAGGTAAAGGAAGCATTAAAAAATGCT AATATAGTGGATATACCTATTAGCGAAAATATTCCTAATACA ACTCTTCATTGGATGATAAGCGATATAACAGGAAAGTCTATT GTGGTTGAACAAACAAAGGAAAAATTAAATGTATTTGATAAT AATATTGGAGTATTAACTAATTCACCTACTTTTGATTGGCAT GTAGCAAATTTAAATCAATATGTAGGTTTGAGATATAATCAA GTTCCAGAATTTAAGTTAGGAGATCAATCTTTAACTGCTTTA GGTCAAGGAACTGGTTTAGTAGGATTACCAGGGGACTTTACA CCTGCATCTAGATTTATAAGAGTAGCATTTTTAAGAGATGCA ATGATAAAAAATGATAAAGATTCAATAGACTTAATTGAATTT TTCCATATATTAAATAATGTTGCTATGGTAAGAGGATCAACT AGAACTGTAGAAGAAAAAGTGATCTTACTCAATATACAAGT TGCATGTGTTTAGAAAAAGGAATTTATTATTATAATACCTAT GAAAATAATCAAATTAATGCAATAGACATGAATAAAGAAAC TTAGATGGAAATGAAATTAAAACATATAAATACAACAAAACT TTAAGTATTAATCATGTAAATTAG |
| Bile salt hydrolase protein from *Clostridium perfringens* SEQ ID NO: 101 | MCTGLALETKDGLHLFGRNMDIEYSFNQSIIFIPRNFKCVNK SNKKELTTKYAVLGMGTIFDDYPTFADGMNEKGLGCAGLNFP VYVSYSKEDIEGKTNIPVYNFLLWVLANFSSVEEVKEALKNA NIVDIPISENIPNTTLHWMISDITGKSIVVEQTKEKLNVFDN NIGVLTNSPTFDWHVANLNQYVGLRYNQVPEFKLGDQSLTAL GQGTGLVGLPGDFTPASRFIRVAFLRDAMIKNDKDSIDLIEF FHILNNVAMVRGSTRTVEEKSDLTQYTSCMCLEKGIYYYNTY ENNQINAIDMNKENLDGNEIKTYKYNKTLSINHVN |
| Bile salt hydrolase from *Enterococcus faecium* SEQ ID NO: 102 | ATGTGTACGTCTATTACTTATGTAACAAGTGATCATTATTTT GGAAGGAATTTTGATTATGAAATATCTTACAATGAAGTAGTT ACTGTTACTCCAAGAAATTATAAGTTGAATTTTCGAAAGGTA AATGATTTGGATACTCATTATGCAATGATTGGTATTGCCGCT GGTATAGCTGACTACCCTCTTTATTACGATGCGACAAATGAA AAAGGATTGAGTATGGCTGGGCTAAATTTTTCTGGGTATGCT GATTATAAAGAAATACAAGAAGGGAAAGACAATGTATCTCCT TTTGAATTTATTCCTTGGATTTTAGGACAATGCTCAACAGTA GGAGAAGCTAAAAAATTGTTAAAAAATATCAATTTAGCAAAT ATAAATTATAGTGACGAACTTCCTTTATCCCCTTTACATTGG CTATTAGCTGATAAAGAAAAATCAATTGTCATTGAAAGTATG AAAGATGGACTTCATATATATGATAACCCTGTGGGCGTTCTT ACCAATAATCCTTCATTTGACTATCAATTATTTAATTTAAAC AATTATCGTGTCTTATCGAGTGAAACTCCTAAAAATAATTTT TCAAATCAAATAAGTTTGAATGCCTATAGCCGCGGTATGGGA GGGATAGGCTTGCCTGGAGATTTATCCTCAGTATCTCGTTTT GTTAAAGCGACTTTTACGAAGCTGAATTCTGTATCTGGAGAT TCAGAGTCAGAAAGTATTAGTCAATTTTTCCATATCTTAGGT TCAGTAGAACAACAAAAGGTTTGTGTGATGTAGGTGATGGA AAATATGAATATACAATTTATTCTTCTTGTTGCAATGTTGAC AAAGGAATCTATTATTATCGAACATATGAAGACAGTCAAATT ACTGCAATTGATATGAATAAAGAAGACTTAGATAGTCATAAG TTAATTAGTTATCCAATTATAGAAAAACAACAAATTAAATAT ATAAATTAG |
| Bile salt hydrolase protein from *Enterococcus faecium* SEQ ID NO: 103 | MCTSITYVTSDHYFGRNFDYEISYNEVVTVTPRNYKLNFRKV NDLDTHYAMIGIAAGIADYPLYYDATNEKGLSMAGLNFSGYA DYKEIQEGKDNVSPFEFIPWILGQCSTVGEAKKLLKNINLAN INYSDELPLSPLHWLLADKEKSIVIESMKDGLHIYDNPVGVL TNNPSFDYQLFNLNNYRVLSSETPKNNFSNQISLNAYSRGMG GIGLPGDLSSVSRFVKATFTKLNSVSGDSESESISQFFHILG |

TABLE 11-continued

Bile Salt Hydrolases

| Gene or Operon | Sequence |
| --- | --- |
| | SVEQQKGLCDVGDGKYEYTIYSSCCNVDKGIYYYRTYEDSQI<br>TAIDMNKEDLDSHKLISYPIIEKQQIKYIN |
| Bile salt hydrolase<br>A from<br>*Lacotbacillus<br>acidophilus*<br>SEQ ID NO: 104 | AAGAGAAAAATATGTGTACATCAATTATATTCAGTCCCAAAG<br>ATCATTACTTTGGTCGTAACCTTGATTTAGAAATTACTTTTG<br>GTCAACAAGTTGTTATTACGCCACGCAATTACACTTTTAAAT<br>TCCGTAAGATGCCCAGTTTAAAAAAGCACTATGCAATGATTG<br>GTATCTCATTAGATATGGATGATTATCCCCTATATTTCGACG<br>CTACAAATGAAAAAGGTTTAGGTATGGCCGGACTCAACTATC<br>CAGGAAATGCTACATATTATGAAGAAAAAGAAAATAAAGATA<br>ATATTGCTTCCTTTGAATTCATCCCTTGGATTTTAGGACAGT<br>GTAGCACTATTAGCGAAGTAAAGGATTTACTTAGCAGAATCA<br>ACATCGCCGATTTAAATTTCAGCGAAAAAATGCAAGCCTCCT<br>CTCTTCACTGGCTTATTGCAGATAAAACAGGTACATCATTAG<br>TTGTTGAAACAGACAAAGATGGAATGCATATTTATGATAATC<br>CAGTTGGCTGCTTAACTAATAATCCACAATTTCCAAAGCAAT<br>TATTCAATTTAAATAACTATGCTGACGTATCTCCAAAAATGC<br>CTAAAAATAACTTCTCAGATAAAGTAAATATGGCTGGCTACA<br>GCCGTGGATTAGGGTCTCACAACTTACCAGGTGGAATGGATT<br>CTGAATCACGTTTTGTCAGAGTAGCTTTCAATAAATTTAATG<br>CTCCAATTGCTGAAACCGAAGAAGAAAATATTGATACTTACT<br>TCCACATTTTACATTCGGTTGAACAACAAAAGGGACTGGATG<br>AAGTTGGTCCAAACTCATTTGAATATACAATTTATTCTGATG<br>GAACTAACTTAGACAAAGGTATTTTCTACTACACCACTTATT<br>CAAACAAACAAATTAACGTTGTTGATATGAATAAAGAAGATC<br>TAGATAGCAGCAATTTGATCACTTATGATATGCTTGATAAAA<br>CTAAATTTAACCATCAAAACTAA |
| Bile salt hydrolase<br>A protein from<br>*Lacotbacillus<br>acidophilus*<br>SEQ ID NO: 105 | MCTSIIFSPKDHYFGRNLDLEITFGQQVVITPRNYTFKFRKM<br>PSLKKHYAMIGISLDMDDYPLYFDATNEKGLGMAGLNYPGNA<br>TYYEEKENKDNIASFEFIPWILGQCSTISEVKDLLSRINIAD<br>LNFSEKMQASSLHWLIADKTGTSLVVETDKDGMHIYDNPVGC<br>LTNNPQFPKQLFNLNNYADVSPKMPKNNFSDKVNMAGYSRGL<br>GSHNLPGGMDSESRFVRVAFNKFNAPIAETEEENIDTYFHIL<br>HSVEQQKGLDEVGPNSFEYTIYSDGTNLDKGIFYYTTYSNKQ<br>INVVDMNKEDLDSSNLITYDMLDKTKFNHQN |
| Bile salt hydrolase<br>B from<br>*Lacotbacillus<br>acidophilus*<br>SEQ ID NO: 106 | AGAAAGCGTGCAGTAAATGTGTACATCAATTTGTTATAATC<br>CTAACGATCATTATTTTGGTAGAAATCTTGACTATGAAATT<br>GCTTATGGTCAAAAAGTAGTCATTGTACCAAGAAACTACGA<br>ATTTAAGTATAGAGAAATGCCCTCTCAAAAGATGCATTATG<br>CTTTTATCGGAGTATCTGTAGTTAATGATGATTATCCATTA<br>TTATGTGATGCAATTAATGAAAAGGGGCTTGGTATTGCAGG<br>ATTAAATTTTCAAGGTCCTAATCATTACTTTCCTAAAATCG<br>AAGGTAAGAAGAATATTGCTTCTTTTGAATTAATGCCATAC<br>TTATTAAGTAATTGTGAAAATACTGACGATGTTAAAGAAAT<br>CTTAGATAATGCAAATATTTTAAATATTAGCTTTTCAGCAA<br>ATTATCCTGCAGCTGATTTACATTGGATTTTAAGTGATAAA<br>GCTGGTAAGAGTATCGTAGTTGAATCAACCAATTCAGGTTT<br>ACATATTTATGATAATCCAGTGAATGTCTTAACTAACAATC<br>CTGAATTTCCGGATCAATTAATTAAATTAAGTGACTACGCC<br>GACGTTACTCCACATAATCCTAAGAATACATTGGTTCCTAA<br>TGTTGATCTTAATCTATATAGTAGAGGCTTAGGTACTCACC<br>ACTTACCTGGTGGAATGGATTCTAGCTCTCGATTTGTTAAG<br>GTAGCTTTTGTCTTGGCACACACTCCACAAGGAAAAAATGA<br>AGTGGAAAATGTTACTAATTATTTCCATATTCTGCATTCAG<br>TAGAACAACCTGATGGTTTAGATGAAGTAGAAGATAATCGC<br>TATGAATATACTATGTATACAGATTGTATGAACTTAGATAA<br>AGGTATTTTGTACTTTACTACTTATGACAATAATCGGATTA<br>ATGCAGTAGATATGCATAAAGCAGATTTAGATTCAGAAGAT<br>TTAATCTGCTACGATTTGTTTAAGAAACAAGATATTGAATA<br>TATGAATTAA |
| Bile salt hydrolase<br>B protein from<br>*Lacotbacillus<br>acidophilus*<br>SEQ ID NO: 107 | MCTSICYNPNDHYFGRNLDYEIAYGQKVVIVPRNYEFKYREM<br>PSQKMHYAFIGVSVVNDDYPLLCDAINEKGLGIAGLNFQGPN<br>HYFPKIEGKKNIASFELMPYLLSNCENTDDVKEILDNANILN<br>ISFSANYPAADLHWILSDKAGKSIVVESTNSGLHIYDNPVNVL<br>TNNPEFPDQLIKLSDYADVTPHNPKNTLVPNVDLNLYSRGL<br>GTHHLPGGMDSSSRFVKVAFVLAHTPQGKNEVENVTNYFHIL<br>HSVEQPDGLDEVEDNRYEYTMYTDCMNLDKGILYFTTYDNNR<br>INAVDMHKADLDSEDLICYDLFKKQDIEYMN |
| Bile salt hydrolase<br>from *Brucella<br>abortus*<br>SEQ ID NO: 108 | ATGGAAACGAAAAGCTCTCTCTGGAAATCATCGCGCCGCGT<br>GCTTGCACATGGGGCTGCAACTGTTCTGGTCGCGGCGGGCC<br>TTATCGTTCCCCAGGCGGCTATGGCTTGCACGAGCTTCGTT<br>CTGCCGACGAGCGACGGTGGTATGGTCTATGGTCGCACGAT |

TABLE 11-continued

Bile Salt Hydrolases

| Gene or Operon | Sequence |
|---|---|
| | GGAATTCGGGTTCAATCTCAAATCCGACATGATTGCCATTC |
| | CGCGCAATTACACCATCACGGCAAGCGGGCCGGACGGTGCT |
| | GCGGGCAAGAAATGGAAGGGCAAATATGCCACGATCGGCAT |
| | GAATGCTTTTGGTATCGTCGCTCTCACCGACGGTATGAACG |
| | AGAAGGGGCTTGCAGGCGGGCTTCTCTATTTCCCGGAATAT |
| | GCCAAGTATCAGGACCCATCCACGGCGAAGCCGGAAGACAG |
| | CCTCGCTCCGTGGGATTTCCTGACCTGGGCGCTGGCCAATT |
| | TTTCGACAGTGGCCGAAGTCAAGGATGCTTTGAGCACCATT |
| | TCCATCGTCGATGTGAAACAAAAGGACCTGGGATTTACCCC |
| | GCCCGCTCACTACACGCTGCATGATGCGACCGGCGCATCCA |
| | TCGTGATCGAACCGATCGACGGCAAGCTCAAGGTTTACGAC |
| | AACAAGCTCGGTGTCATGACCAATTCGCCGTCTTTCGACTG |
| | GCACATGACCAATCTGCGCAACTATGTCTATCTCTCGCGTG |
| | AAAATCCGAAGCCGTTGCAGATCCTTGGCGAGACGATCCAG |
| | TCATTCGGGCAAGGCGCCGGTATGCATGGTATTCCGGGCGA |
| | CACCACGCCGCCATCGCGTTTCGTGCGTGCAAGCGCCTACG |
| | TCCTTTCCGCCAAGAAGGTGCCGAGCGGCCTTGAAAGCGTG |
| | CGGCTGGCCGAGCATATTGCCAATAACTTCGACATTCCAAA |
| | GGGATGGAGCGAAGAGCAGAATATGTTTGAATATACCCAGT |
| | GGACCGCCTTTGCGGACATGAAGAACGATGTCTATTACATC |
| | AAGACCTATGACGATCAGGTTCTGCGCAGCTTCAGCTTCAA |
| | GGATTTTGATGTCGATAGCAAAGATATTCTAACGATCAAGT |
| | TCGAGCCAAAACTGGACGCGCCGTCACTGAAAAAGTAA |
| Bile salt hydrolase protein from *Brucella abortus* SEQ ID NO: 109 | METKSSLWKSSRRVLAHGAATVLVAAGLIVPQAAMACTSFVL PTSDGGMVYGRTMEFGFNLKSDMIAIPRNYTITASGPDGAAG KKWKGKYATIGMNAFGIVALTDGMNEKGLAGGLLYFPEYAKY QDPSTAKPEDSLAPWDF the bile salt hydrolase gene has at least about 96%, 97%, 98%, or 99% identity with the entire sequence of SEQ ID NO: 96. Accordingly, in one embodiment, the bile salt hydrolase gene has at least about 80%, 81%, 82%, 83%, 84%, 85%, 86%, 87%, 88%, 89%, 90%, 91%, 92%, 93%, 94%, 95%, 96%, 97%, 98%, or 99% identity with the entire sequence of SEQ ID NO: 96. In another embodiment, the bile salt hydrolase gene comprises the sequence of SEQ ID NO: 96. In yet another embodiment the bile salt hydrolase gene consists of the sequence of SEQ ID NO: 96.

In one embodiment, the bile salt hydrolase gene has at least about 80% identity with the entire sequence of SEQ ID NO: 98. In another embodiment, the bile salt hydrolase gene has at least about 85% identity with the entire sequence of SEQ ID NO: 98. In one embodiment, the bile salt hydrolase gene has at least about 90% identity with the entire sequence of SEQ ID NO: 98. In one embodiment, the bile salt hydrolase gene has at least about 95% identity with the entire sequence of SEQ ID NO: 98. In another embodiment, the bile salt hydrolase gene has at least about 96%, 97%, 98%, or 99% identity with the entire sequence of SEQ ID NO: 98. Accordingly, in one embodiment, the bile salt hydrolase gene has at least about 80%, 81%, 82%, 83%, 84%, 85%, 86%, 87%, 88%, 89%, 90%, 91%, 92%, 93%, 94%, 95%, 96%, 97%, 98%, or 99% identity with the entire sequence of SEQ ID NO: 98. In another embodiment, the bile salt hydrolase gene comprises the sequence of SEQ ID NO: 98. In yet another embodiment the bile salt hydrolase gene consists of the sequence of SEQ ID NO: 98.

In one embodiment, the bile salt hydrolase gene has at least about 80% identity with the entire sequence of SEQ ID NO: 100. In another embodiment, the bile salt hydrolase gene has at least about 85% identity with the entire sequence of SEQ ID NO: 100. In one embodiment, the bile salt hydrolase gene has at least about 90% identity with the entire sequence of SEQ ID NO: 100. In one embodiment, the bile salt hydrolase gene has at least about 95% identity with the entire sequence of SEQ ID NO: 100. In another embodiment, the bile salt hydrolase gene has at least about 96%, 97%, 98%, or 99% identity with the entire sequence of SEQ ID NO: 100. Accordingly, in one embodiment, the bile salt hydrolase gene has at least about 80%, 81%, 82%, 83%, 84%, 85%, 86%, 87%, 88%, 89%, 90%, 91%, 92%, 93%, 94%, 95%, 96%, 97%, 98%, or 99% identity with the entire sequence of SEQ ID NO: 100. In another embodiment, the bile salt hydrolase gene comprises the sequence of SEQ ID NO: 100. In yet another embodiment the bile salt hydrolase gene consists of the sequence of SEQ ID NO: 100.

In one embodiment, the bile salt hydrolase gene has at least about 80% identity with the entire sequence of SEQ ID NO: 102. In another embodiment, the bile salt hydrolase gene has at least about 85% identity with the entire sequence of SEQ ID NO: 102. In one embodiment, the bile salt hydrolase gene has at least about 90% identity with the entire sequence of SEQ ID NO: 102. In one embodiment, the bile salt hydrolase gene has at least about 95% identity with the entire sequence of SEQ ID NO: 102. In another embodiment, the bile salt hydrolase gene has at least about 96%, 97%, 98%, or 99% identity with the entire sequence of SEQ ID NO: 102. Accordingly, in one embodiment, the bile salt hydrolase gene has at least about 80%, 81%, 82%, 83%, 84%, 85%, 86%, 87%, 88%, 89%, 90%, 91%, 92%, 93%, 94%, 95%, 96%, 97%, 98%, or 99% identity with the entire sequence of SEQ ID NO: 102. In another embodiment, the bile salt hydrolase gene comprises the sequence of SEQ ID NO: 102. In yet another embodiment the bile salt hydrolase gene consists of the sequence of SEQ ID NO: 102.

In one embodiment, the bile salt hydrolase gene has at least about 80% identity with the entire sequence of SEQ ID NO: 104. In another embodiment, the bile salt hydrolase gene has at least about 85% identity with the entire sequence of SEQ ID NO: 104. In one embodiment, the bile salt hydrolase gene has at least about 90% identity with the entire sequence of SEQ ID NO: 104. In one embodiment, the bile salt hydrolase gene has at least about 95% identity with the entire sequence of SEQ ID NO: 104. In another embodiment, the bile salt hydrolase gene has at least about 96%, 97%, 98%, or 99% identity with the entire sequence of SEQ ID NO: 104. Accordingly, in one embodiment, the bile salt hydrolase gene has at least about 80%, 81%, 82%, 83%, 84%, 85%, 86%, 87%, 88%, 89%, 90%, 91%, 92%, 93%, 94%, 95%, 96%, 97%, 98%, or 99% identity with the entire sequence of SEQ ID NO: 104. In another embodiment, the bile salt hydrolase gene comprises the sequence of SEQ ID NO: 104. In yet another embodiment the bile salt hydrolase gene consists of the sequence of SEQ ID NO: 104.

In one embodiment, the bile salt hydrolase gene has at least about 80% identity with the entire sequence of SEQ ID NO: 106. In another embodiment, the bile salt hydrolase gene has at least about 85% identity with the entire sequence of SEQ ID NO: 106. In one embodiment, the bile salt hydrolase gene has at least about 90% identity with the entire sequence of SEQ ID NO: 106. In one embodiment, the bile salt hydrolase gene has at least about 95% identity with the entire sequence of SEQ ID NO: 106. In another embodiment, the bile salt hydrolase gene has at least about 96%, 97%, 98%, or 99% identity with the entire sequence of SEQ ID NO: 106. Accordingly, in one embodiment, the bile salt hydrolase gene has at least about 80%, 81%, 82%, 83%, 84%, 85%, 86%, 87%, 88%, 89%, 90%, 91%, 92%, 93%, 94%, 95%, 96%, 97%, 98%, or 99% identity with the entire sequence of SEQ ID NO: 106. In another embodiment, the bile salt hydrolase gene comprises the sequence of SEQ ID NO: 106. In yet another embodiment the bile salt hydrolase gene consists of the sequence of SEQ ID NO: 106.

In one embodiment, the bile salt hydrolase gene has at least about 80% identity with the entire sequence of SEQ ID NO: 108. In another embodiment, the bile salt hydrolase gene has at least about 85% identity with the entire sequence of SEQ ID NO: 108. In one embodiment, the bile salt hydrolase gene has at least about 90% identity with the entire sequence of SEQ ID NO: 108. In one embodiment, the bile salt hydrolase gene has at least about 95% identity with the entire sequence of SEQ ID NO: 108. In another embodiment, the bile salt hydrolase gene has at least about 96%, 97%, 98%, or 99% identity with the entire sequence of SEQ ID NO: 108. Accordingly, in one embodiment, the bile salt hydrolase gene has at least about 80%, 81%, 82%, 83%, 84%, 85%, 86%, 87%, 88%, 89%, 90%, 91%, 92%, 93%, 94%, 95%, 96%, 97%, 98%, or 99% identity with the entire sequence of SEQ ID NO: 108. In another embodiment, the bile salt hydrolase gene comprises the sequence of SEQ ID NO: 108. In yet another embodiment the bile salt hydrolase gene consists of the sequence of SEQ ID NO: 108.

In one embodiment, one or more polypeptides encoded by the and expressed by the genetically engineered bacteria have at least about 80% identity with one or more of SEQ ID NO: 91, 93, 95, 97, 99, 101, 103, 105, 107, and 109. In another embodiment, one or more polypeptides encoded by the propionate circuits and expressed by the genetically engineered bacteria have at least about 85% identity with one or more of SEQ ID NO: 91, 93, 95, 97, 99, 101, 103, 105, 107, and 109. In one embodiment, one or more polypeptides encoded by the propionate circuits and expressed by the genetically engineered bacteria have at least about 90% identity with with one or more of SEQ ID NO: 91, 93, 95, 97, 99, 101, 103, 105, 107, and 109. In one embodiment, one or more polypeptides encoded by the propionate circuits and expressed by the genetically engineered bacteria have at least about 95% identity with with one or more of SEQ ID NO: 91, 93, 95, 97, 99, 101, 103, 105, 107, and 109. In another embodiment, one or more polypeptides encoded by the propionate circuits and expressed by the genetically engineered bacteria have at least about 96%, 97%, 98%, or 99% identity with one or more of SEQ ID NO: 91, 93, 95, 97, 99, 101, 103, 105, 107, and 109. Accordingly, in one embodiment, one or more polypeptides encoded by the propionate circuits and expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 91, 93, 95, 97, 99, 101, 103, 105, 107, and 109. In another embodiment, one or more polypeptides encoded by the propionate circuits and expressed by the genetically engineered bacteria one or more polypeptides encoded by the propionate circuits and expressed by the genetically engineered bacteria comprise the sequence of with one or more of SEQ ID NO: 91, 93, 95, 97, 99, 101, 103, 105, 107, and 109. In yet another embodiment one or more polypeptides encoded by the propionate circuits and expressed by the genetically engineered bacteria consist of the sequence of with one or more of SEQ ID NO: 91, 93, 95, 97, 99, 101, 103, 105, 107, and 109.

In one embodiment, the gene encoding the bile salt hydrolase enzyme is directly operably linked to a first promoter. In another embodiment, the gene encoding the bile salt hydrolase enzyme is indirectly operably linked to a first promoter. In one embodiment, the promoter is not operably linked with the gene encoding the bile salt hydrolase enzyme in nature.

In some embodiments, the gene encoding the bile salt hydrolase enzyme is expressed under the control of a constitutive promoter. In another embodiment, the gene encoding the bile salt hydrolase enzyme is expressed under the control of an inducible promoter. In some embodiments, the gene encoding the bile salt hydrolase enzyme is expressed under the control of a promoter that is directly or indirectly induced by exogenous environmental conditions. In one embodiment, the gene encoding the bile salt hydrolase enzyme is expressed under the control of a promoter that is directly or indirectly induced by low-oxygen or anaerobic conditions, wherein expression of the gene encoding the bile salt hydrolase enzyme is activated under low-oxygen or anaerobic environments, such as the environment of the mammalian gut. Inducible promoters are described in more detail infra.

In some embodiments, the genetically engineered bacteria are capable of expressing bile sale hydrolase under inducing conditions, e.g., under a condition(s) associated with inflammation. In some embodiments, the genetically engineered bacteria are capable of expressing bile sale hydrolase in low-oxygen conditions, in the presence of certain molecules or metabolites, in the presence of molecules or metabolites associated with liver damage, metabolic disease, inflammation or an inflammatory response, or in the presence of some other metabolite that may or may not be present in the gut, such as arabinose.

The gene encoding the bile salt hydrolase enzyme may be present on a plasmid or chromosome in the bacterial cell. In one embodiment, the gene encoding the bile salt hydrolase enzyme is located on a plasmid in the bacterial cell. In another embodiment, the gene encoding the bile salt hydrolase is located in the chromosome of the bacterial cell. In yet another embodiment, a native copy of the gene encoding the bile salt hydrolase enzyme is located in the chromosome of the bacterial cell, and a gene encoding a bile salt hydrolase enzyme from a different species of bacteria is located on a plasmid in the bacterial cell. In yet another embodiment, a native copy of the gene encoding the bile salt hydrolase enzyme is located on a plasmid in the bacterial cell, and a gene encoding the bile salt hydrolase enzyme from a different species of bacteria is located on a plasmid in the bacterial cell. In yet another embodiment, a native copy of the gene encoding the bile salt hydrolase enzyme is located in the chromosome of the bacterial cell, and a gene encoding the bile salt hydrolase enzyme from a different species of bacteria is located in the chromosome of the bacterial cell. For example, *E. coli* comprises a native bile salt hydrolase gene.

In some embodiments, the gene encoding the bile salt hydrolase enzyme is expressed on a low-copy plasmid. In some embodiments, the gene encoding the bile salt hydrolase enzyme is expressed on a high-copy plasmid. In some embodiments, the high-copy plasmid may be useful for increasing expression of the bile salt hydrolase enzyme, thereby increasing the catabolism of bile salts.

Transporters of Bile Salts and Bile Acids

The uptake of bile salts into the *Lactobacillus* and *Bifidobacterium* has been found to occur via the bile salt transporters CbsT1 and CbsT2 (see, e.g., Elkins et al., *Microbiology*, 147(Pt. 12):3403-3412 (2001), the entire contents of which are expressly incorporated herein by reference). The uptake of bile acids into the *Neisseria meningitides* has been found to occur via the bile acid sodium symporter ASBT (see, e.g., Hu et al., Nature, 478(7369): 408-411 (2011), the contents of which are expressly incorporated herein by reference. Other proteins that mediate the import of bile salts or acids into cells are well known to those of skill in the art. For the purposes of this invention, a bile salt transporter includes bile salt importers and bile acid symporters.

Bile salt transporters, e.g., bile salt importers or bile acid symporters, may be expressed or modified in the bacteria in order to enhance bile salt or acid transport into the cell. Specifically, when the transporter of bile salts is expressed in the recombinant bacterial cells, the bacterial cells import more bile salts into the cell when the transporter is expressed than unmodified bacteria of the same bacterial subtype under the same conditions. Thus, the genetically engineered bacteria comprising a heterologous gene encoding a transporter of bile salts may be used to import bile salts into the bacteria so that any gene encoding a bile salt hydrolase (BSH) enzyme expressed in the organism can be used to treat disorders associated with bile salts, such as cardiac disease, metabolic disease, liver disease, cancer, and *C. difficile* infection. In one embodiment, the bacterial cell comprises a heterologous gene encoding a transporter of a bile salt. In one embodiment, the bacterial cell comprises a heterologous gene encoding a transporter of a bile salt and a heterologous gene encoding a bile salt hydrolase (BSH) enzyme.

Thus, in some embodiments, the disclosure provides a bacterial cell that comprises a heterologous gene encoding a bile salt hydrolase enzyme operably linked to a first promoter and a heterologous gene encoding a transporter of a bile salt. In some embodiments, the disclosure provides a bacterial cell that comprises a heterologous gene encoding a transporter of a bile salt operably linked to the first promoter. In another embodiment, the disclosure provides a bacterial cell that comprises a heterologous gene encoding at least one bile salt hydrolase enzyme operably linked to a first promoter and a heterologous gene encoding transporter of a bile salt operably linked to a second promoter. In one embodiment, the first promoter and the second promoter are separate copies of the same promoter. In another embodiment, the first promoter and the second promoter are different promoters.

In one embodiment, the bacterial cell comprises a gene encoding a transporter of a bile salt from a different organism, e.g., a different species of bacteria. In one embodiment, the bacterial cell comprises at least one native gene encoding transporter of a bile salt. In some embodiments, the at least one native gene encoding atransporter of a bile salt is not modified. In another embodiment, the bacterial cell comprises more than one copy of at least one native gene encoding a transporter of a bile salt. In yet another embodiment, the bacterial cell comprises a copy of a gene encoding a native transporter of a bile salt, as well as at least one copy of a heterologous gene encoding a transporter of a bile salt from a different bacterial species. In one embodiment, the bacterial cell comprises at least one, two, three, four, five, or six copies of the heterologous gene encoding a transporter of a bile salt. In one embodiment, the bacterial cell comprises multiple copies of the heterologous gene encoding a transporter of a bile salt.

In some embodiments, the transporter of a bile salt is encoded by a transporter of a bile salt gene derived from a bacterial genus or species, including but not limited to, *Lactobacillus*. In some embodiments, the transporter of a bile salt gene is derived from a bacteria of the species *Lactobacillus johnsonni* strain 100-100.

The present disclosure further comprises genes encoding functional fragments of a transporter of a bile salt or functional variants of a transporter of a bile salt. As used herein, the term "functional fragment thereof" or "functional variant thereof" of a transporter of a bile salt relates to an element having qualitative biological activity in common with the wild-type transporter of a bile salt from which the fragment or variant was derived. For example, a functional fragment or a functional variant of a mutated transporter of bile salt protein is one which retains essentially the same ability to import the bile salt into the bacterial cell as does the transporter protein from which the functional fragment or functional variant was derived. In one embodiment, the recombinant bacterial cell comprises a heterologous gene encoding a functional fragment of a transporter of a bile salt. In another embodiment, the recombinant bacterial cell comprises a heterologous gene encoding a functional variant of a transporter of a bile salt.

Assays for testing the activity of a transporter of a bile salt, a functional variant of a transporter of a bile salt, or a functional fragment of a transporter of a bile salt are well known to one of ordinary skill in the art. For example, bile salt import can be assessed as described in Elkins et al., *Microbiology*, 147:3403-3412 (2001), the entire contents of which are expressly incorporated herein by reference.

In one embodiment the gene(s) encoding the transporter of a bile salt have been codon-optimized for use in the host organism. In one embodiment, the genes encoding the transporter of a bile salt have been codon-optimized for use in *Escherichia coli*.

The present disclosure also encompasses genes encoding a transporter of a bile salt comprising amino acids in its sequence that are substantially the same as an amino acid sequence described herein. Amino acid sequences that are substantially the same as the sequences described herein include sequences comprising conservative amino acid substitutions, as well as amino acid deletions and/or insertions.

In some embodiments, the gene encoding a transporter of a bile salt is mutagenized; mutants exhibiting increased bile salt transport are selected; and the mutagenized a gene encoding a transporter of a bile salt is isolated and inserted into the bacterial cell. In some embodiments, the gene encoding a transporter of a bile salt is mutagenized; mutants exhibiting decreased bile salt transport are selected; and the mutagenized a gene encoding a transporter of the bile salt is isolated and inserted into the bacterial cell. The transporter modifications described herein may be present on a plasmid or chromosome. Non-limiting examples of bile salt transporters, which are encoded in the genetically engineered bacteria, are in Table 12.

TABLE 12

Bile Salt Transport and Export Sequences

| Description | Sequence |
| --- | --- |
| cbsT1 from *Lactobacillus johnsonii* SEQ ID NO: 110 | ATGTCGACCACACCGACACAGCCATCATCACGAAAACAG GCTGTTTACCCGTACTTGATCGTGCTGTCGGGCATCGTCT TCACGGCCATCCCGGTATCGCTGGTCTGCAGTTGCGCAGG TATCTTCTTCACGCCTGTCAGCAGCTACTTCCATGTTCCCA AGGCCGCATTCACCGGATATTTCAGCATATTCAGCATCAC CATGGTCGCCTTCCTGCCGGTGGCCGGATGGCTGATGCAC CGCTACGATCTGCGCATCGTACTGACCGCAAGCACCGTCC TGGCTGGACTGGGCTGCCTGGGTATGTCCCGATCATCCGC CATGTGGCAGTTCTATCTATGCGGAGTGGTTCTGGGAATC GGCATGCCGGCCGTCCTCTATCTGTCAGTGCCAACACTCA TCAACGCCTGGTTCCGCAAGCGGGTCGGGTTCTTCATCGG CCTGTGCATGGCCTTCACCGGCATAGGCGGCGTGATCTTC AACCAGATAGGCACCATGATCATCAGATCCGCCCCTGAT GGATGGAGGCGGGGATATCTGGTTTTCGCTATTCTCATCC TGGTGATCACCCTGCCCTTCACCATTTTCGTCATTCGCAG CACACCCGAACAGATGGGTCTGCATCCCTACGGCGCCGA CCAGGAGCCTGATGCAGCTGAGACGGCCACCAATAGTGC AGGCACCGGGAGCAAAGACCAAAAGAGTCCTGAGCCTGC AGCGTCAACCGTAGGCATGACTGCCTCCCAGGCCTTGCGC TCCCCTGCCTTCTGGGCGCTGGCGCTCTTCTGCGGTCTGA TCACCATGAATCAGACCATTTACCAGTTCCTGCCCTCCTA CGCGGCATCCCTGCCATCCATGGCAGCCTACACGGGACT GATCGCCTCCTCCTGCATGCCGGCCAGGCCATCGGCAA GATCATCCTGGGCATGGTCAACGACGGCAGCATCGTAGG |

TABLE 12-continued

Bile Salt Transport and Export Sequences

| Description | Sequence |
|---|---|
| | CGGTCTCTGTCTGGGCATCGGCGGCGGCATTCTCGGCGTC<br>TGCCTCATGGTCGCCTTCCCCGGATTGCCCGTGCTCCTCCT<br>GCTGGGAGCCTTTGCCTTCGGCCTTGTCTACGCCTGCACT<br>ACTGTGCAGACACCAATCCTGGTTACAGCGGTCTTCGGCT<br>CGCGCGACTACACCAACATCTATGCACGTATCCAGATGGT<br>TGGGTCCCTAGCCTCGGCCTTCGCAGCTCTCTTCTGGGGC<br>GCCATCGCTGACCAGCCCCACGGCTACATCATCATGTTCG<br>GTCTGAGCATCCTGATCATGGTTGTGGCCTTGTTCCTAGG<br>CATTATCCCTCTGAAAGGTACGCGCAAGTTGACCGATCAG<br>ATCGCCTGA |
| CbsT1 protein from Lactobacillus johnsonii SEQ ID NO: 111 | MSTTPTQPSSRKQAVYPYLIVLSGIVFTAIPVSLVCSCAGIFFT<br>PVSSYFHVPKAAFTGYFSIFSITMVAFLPVAGWLMHRYDLRI<br>VLTASTVLAGLGCLGMSRSSAMWQFYLCGVVLGIGMPAVL<br>YLSVPTLINAWFRKRVGFFIGLCMAFTGIGGVIFNQIGTMIIR<br>SAPDGWRRGYLVFAILILVITLPFTIFVIRSTPEQMGLHPYGA<br>DQEPDAAETATNSAGTGSKDQKSPEPAASTVGMTASQALRS<br>PAFWALALECGLITMNQTIYQFLPSYAASLPSMAAYTGLIAS<br>SCMAGQAIGKIILGMVNDGSIVGGLCLGIGGGILGVCLMVAF<br>PGLPVLLLLGAFAFGLVYACTTVQTPILVTAVFGSRDYTNIY<br>ARIQMVGSLASAFAALFWGAIADQPHGYIIMFGLSILIMVVA<br>LFLGIIPLKGTRKLTDQIA |
| cbsT2 from Lactobacillus johnsonii SEQ ID NO: 112 | ATGTCTACTGATGCCGCTACTAAAGATAAAGTAGTAAGC<br>AAGGGCTATAAATACTTCATGGTTTTCCTTTGTATGTTAA<br>CCCAAGCTATTCCTTATGGAATTGCTCAAAACATTCAGCC<br>TTTGTTTATCCACCCTTTAGTTAATACTTTCCACTTTACCT<br>TAGCATCGTACACATTAATTTTTACGTTTGGTGCGGTTTTT<br>GCTTCAGTTGCTTCTCCATTTATTGGTAAGGCATTAGAAA<br>AAGTTAACTTCCGACTAATGTATTTAATTGGTATTGGTCT<br>TTCTGCTATTGCCTACGTAATTTTTGGAATTAGTACAAAA<br>CTACCCGGTTTCTATATTGCCGCTATCATTTGTATGGTTGG<br>TTCAACCTTTTACTCCGGCCAAGGTGTTCCCTGGGTTATT<br>AACCACTGGTTCCCAGCAAAGGGACGTGGGGCTGCCTTA<br>GGAATTGCCTTCTGCGGTGGTTCTATTGGTAATATCTTTTT<br>ACAACCAGCAACCCAAGCTATTTTAAAACACTACATGAC<br>AGGTAATACTAAGACCGGTCATTTAACCTCTATGGCACCA<br>TTCTTTATCTTTGCCGTAGCTTTATTAGTAATCGGTGTAAT<br>TATCGCCTGCTTCATTAGAACCCCTAAGAAAGACGAAATT<br>GTTGTTTCTGATGCAGAACTAGCTGAAAGCAAGAAAGCT<br>GAAGCCGCAGCCAAAGCTAAAGAGTTTAAAGGCTGGACT<br>AGTAAACAAGTGTTACAAATGAAATGGTTCTGGATTTTCA<br>GCCTTGGTTTCTTAATCATTGGTTTAGGCTTAGCTTCTTTA<br>AATGAAGACTATGCCGCCTTCCTTGATACTAAGCTTTCTT<br>TAACCGATGTTGGTTTAGTTGGGTCAATGTACGGTGTTGG<br>TTGTTTAATCGGAAATATTTCTGGTGGTTTCTTATTTGATA<br>AATTTGGTACAGCAAAATCAATGACCTATGCTGGTTGTAT<br>GTATATTTTATCTATTCTGATGATGATCTTTATTAGCTTCC<br>AGCCATATGGTTCATCTATTAGTAAGGCTGCTGGCATTGG<br>CTATGCTATCTTTTGCGGCTTAGCTGTATTTAGTTACATGT<br>CAGGCCCAGCCTTCATGGCAAAAGACCTCTTTGGTTCAAG<br>AGATCAAGGTGTCATGCTTGGATACGTTGGTTTAGCTTAT<br>GCAATTGGCTATGCCATTGGTGCTCCACTATTTGGGATTA<br>TTAAGGGAGCGGCAAGCTTTACAGTTGCTTGGTACTTTAT<br>GATTGCCTTTGTTGCAATTGGTTTTATCATTTTAGTATTTG<br>CCGTTATCCAAATTAAGAGATACCAAAAGAAATACATTG<br>CAGAGCAAGCAGCAAAAGCTAATGCTAAATAA |
| CbsT2 protein from Lactobacillus johnsonii SEQ ID NO: 113 | MSTDAATKDKVVSKGYKYFMVFLCMLTQAIPYGIAQNIQPL<br>FIHPLVNTFHFTLASYTLIFTFGAVFASVASPPFIGKALEKVNF<br>RLMYLIGIGLSAIAYVIFGISTKLPGFYIAAIICMVGSTFYSGQ<br>GVPWVINHWFPAKGRGAALGIAFCGGSIGNIFLQPATQAILK<br>HYMTGNTKTGHLTSMAPPFIFAVALLVIGVIIACFIRTPKKDE<br>IVVSDAELAESKKAEAAAKAKEFKGWTSKQVLQMKWFWIF<br>SLGFLIIGLGLASLNEDYAAFLDTKLSLTDVGLVGSMYGVG<br>CLIGNISGGFLFDKFGTAKSMTYAGCMYTILSILMMIFISFQPY<br>GSSISKAAGIGYAIFCGLAVFSYMSGPAFMAKDLFGSRDQG<br>VMLGYVGLAYAIGYAIGAPLFGIIKGAASFTVAWYFMIAFV<br>AIGFIILVFAVIQIKRYQKKYIAEQAAKANAK |
| ABCB11 bile salt exporter Homo sapiens SEQ ID NO: 114 | GAATGATGAAAACCGAGGTTGGAAAAGGTTGTGAAACCT<br>TTTAACTCTCCACAGTGGAGTCCATTATTTCCTCTGGCTTC<br>CTCCAATTCATATTCACAGGGTCGTTGGCTGTGGGTTGCA<br>ATTACCATGTCTGACTCAGTAATTCTTCGAAGTATAAGA<br>AATTTGGAGAGGAGAATGATGGTTTTGAGTCAGATAAAT<br>CATATAATAATGATAAGAAATCAAGGTTACAAGATGAGA |

TABLE 12-continued

Bile Salt Transport and Export Sequences

| Description | Sequence |
|---|---|
| | AGAAAGGTGATGGCGTTAGAGTTGGCTTCTTTCAATTGTT |
| | TCGGTTTTCTTCATCAACTGACATTTGGCTGATGTTTGTGG |
| | GAAGTTTGTGTGCATTTCTCCATGGAATAGCCCAGCCAGG |
| | CGTGCTACTCATTTTTGGCACAATGACAGATGTTTTTATT |
| | GACTACGACGTTGAGTTACAAGAACTCCAGATTCCAGGA |
| | AAAGCATGTGTGAATAACACCATTGTATGGACTAACAGT |
| | TCCCTCAACCAGAACATGACAAATGGAACACGTTGTGGG |
| | TTGCTGAACATCGAGAGCGAAATGATCAAATTTGCCAGTT |
| | ACTATGCTGGAATTGCTGTCGCAGTACTTATCACAGGATA |
| | TATTCAAATATGCTTTTGGGTCATTGCCGCAGCTCGTCAG |
| | ATACAGAAAATGAGAAAATTTTACTTTAGGAGAATAATG |
| | AGAATGGAAATAGGGTGGTTTGACTGCAATTCAGTGGGG |
| | GAGCTGAATACAAGATTCTCTGATGATATTAATAAAATCA |
| | ATGATGCCATAGCTGACCAAATGGCCCTTTTCATTCAGCG |
| | CATGACCTCGACCATCTGTGGTTTCCTGTTGGGATTTTTCA |
| | GGGGTTGGAAACTGACCTTGGTTATTATTTCTGTCAGCCC |
| | TCTCATTGGGATTGGAGCAGCCACCATTGGTCTGAGTGTG |
| | TCCAAGTTTACGGACTATGAGCTGAAGGCCTATGCCAAA |
| | GCAGGGGTGGTGGCTGATGAAGTCATTTCATCAATGAGA |
| | ACAGTGGCTGCTTTTGGTGGTGAGAAAAGAGAGGTTGAA |
| | AGGTATGAGAAAAATCTTGTGTTCGCCCAGCGTTGGGGA |
| | ATTAGAAAAGGAATAGTGATGGGATTCTTTACTGGATTCG |
| | TGTGGTGTCTCATCTTTTTGTGTTATGCACTGGCCTTCTGG |
| | TACGGCTCCACACTTGTCCTGGATGAAGGAGAATATACA |
| | CCAGGAACCCTTGTCCAGATTTTCCTCAGTGTCATAGTAG |
| | GAGCTTTAAATCTTGGCAATGCCTCTCCTTGTTTGGAAGC |
| | CTTTGCAACTGGACGTGCAGCAGCCACCAGCATTTTTGAG |
| | ACAATAGACAGGAAACCCATCATTGACTGCATGTCAGAA |
| | GATGGTTACAAGTTGGATCGAATCAAGGGTGAAATTGAA |
| | TTCCATAATGTGACCTTCCATTATCCTTCCAGACCAGAGG |
| | TGAAGATTCTAAATGACCTCAACATGGTCATTAAACCAG |
| | GGGAAATGACAGCTCTGGTAGGACCCAGTGGAGCTGGAA |
| | AAAGTACAGCACTGCAACTCATTCAGCGATTCTATGACCC |
| | CTGTGAAGGAATGGTGACCGTGGATGGCCATGACATTCG |
| | CTCTCTTAACATTCAGTGGCTTAGAGATCAGATTGGGATA |
| | GTGGAGCAAGAGCCAGTTCTGTTCTCTACCACCATTGCAG |
| | AAAATATTCGCTATGGCAGAGAAGATGCAACAATGGAAG |
| | ACATAGTCCAAGCTGCCAAGGAGGCCAATGCCTACAACT |
| | TCATCATGGACCTGCCACAGCAATTTGACACCCTTGTTGG |
| | AGAAGGAGGAGGCCAGATGAGTGGTGGCCAGAAACAAA |
| | GGGTAGCTATCGCCAGAGCCCTCATCCGAAATCCCAAGA |
| | TTCTGCTTTTGGACATGGCCACCTCAGCTCTGGACAATGA |
| | GAGTGAAGCCATGGTGCAAGAAGTGCTGAGTAAGATTCA |
| | GCATGGGCACACAATCATTTCAGTTGCTCATCGCTTGTCT |
| | ACGGTCAGAGCTGCAGATACCATCATTGGTTTTGAACATG |
| | GCACTGCAGTGGAAAGAGGGACCCATGAAGAATTACTGG |
| | AAAGGAAAGGTGTTTACTTCACTCTAGTGACTTTGCAAAG |
| | CCAGGGAAATCAAGCTCTTAATGAAGAGGACATAAAGGA |
| | TGCAACTGAAGATGACATGCTTGCGAGGACCTTTAGCAG |
| | AGGGAGCTACCAGGATAGTTTAAGGGCTTCCATCCGGCA |
| | ACGCTCCAAGTCTCAGCTTTCTTACCTGGTGCACGAACCT |
| | CCATTAGCTGTTGTAGATCATAAGTCTACCTATGAAGAAG |
| | ATAGAAAGGACAAGGACATTCCTGTGCAGGAAGAAGTTG |
| | AACCTGCCCCAGTTAGGAGGATTCTGAAATTCAGTGCTCC |
| | AGAATGGCCCTACATGCTGGTAGGGTCTGTGGGTGCAGC |
| | TGTGAACGGGACAGTCACACCCTTGTATGCCTTTTTATTC |
| | AGCCAGATTCTTGGGACTTTTTCAATTCCTGATAAAGAGG |
| | AACAAAGGTCACAGATCAATGGTGTGTGCCTACTTTTTGT |
| | AGCAATGGGCTGTGTATCTCTTTTCACCCAATTTCTACAG |
| | GGATATGCCTTTGCTAAATCTGGGGAGCTCCTAACAAAA |
| | AGGCTACGTAAATTTGGTTTCAGGGCAATGCTGGGGCAA |
| | GATATTGCCTGGTTTGATGACCTCAGAAATAGCCCTGGAG |
| | CATTGACAACAAGACTTGCTACAGATGCTTCCCAAGTTCA |
| | AGGGGCTGCCGGCTCTCAGATCGGGATGATAGTCAATTC |
| | CTTCACTAACGTCACTGTGGCCATGATCATTGCCTTCTCCT |
| | TTAGCTGGAAGCTGAGCCTGGTCATCTTGTGCTTCTTCCC |
| | CTTCTTGGCTTTATCAGGAGCCACACAGACCAGGATGTTG |
| | ACAGGATTTGCCTCTCGAGATAAGCAGGCCCTGGAGATG |
| | GTGGGACAGATTACAAATGAAGCCCTCAGTAACATCCGC |
| | ACTGTTGCTGGAATTGGAAAGGAGAGGCGGTTCATTGAA |
| | GCACTTGAGACTGAGCTGGAGAAGCCCTTCAAGACAGCC |
| | ATTCAGAAAGCCAATATTTACGGATTCTGCTTTGCCTTTG |
| | CCCAGTGCATCATGTTTATTGCGAATTCTGCTTCCTACAG |
| | ATATGGAGGTTACTTAATCTCCAATGAGGGGCTCCATTTC |
| | AGCTATGTGTTCAGGGTGATCTCTGCAGTTGTACTGAGTG |
| | CAACAGCTCTTGGAAGAGCCTTCTCTTACACCCCAAGTTA |

TABLE 12-continued

Bile Salt Transport and Export Sequences

| Description | Sequence |
|---|---|
| | TGCAAAAGCTAAAATATCAGCTGCACGCTTTTTTCAACTG<br>CTGGACCGACAACCCCCAATCAGTGTATACAATACTGCA<br>GGTGAAAAATGGGACAACTTCCAGGGGAAGATTGATTTT<br>GTTGATTGTAAATTTACATATCCTTCTCGACCTGACTCGC<br>AAGTTCTGAATGGTCTCTCAGTGTCGATTAGTCCAGGGCA<br>GACACTGGCGTTTGTTGGGAGCAGTGGATGTGGCAAAAG<br>CACTAGCATTCAGCTGTTGGAACGTTTCTATGATCCTGAT<br>CAAGGGAAGGTGATGATAGATGGTCATGACAGCAAAAAA<br>GTAAATGTCCAGTTCCTCCGCTCAAACATTGGAATTGTTT<br>CCCAGGAACCAGTGTTGTTTGCCTGTAGCATAATGGACAA<br>TATCAAGTATGGAGACAACACCAAAGAAATTCCCATGGA<br>AAGAGTCATAGCAGCTGCAAAACAGGCTCAGCTGCATGA<br>TTTTGTCATGTCACTCCCAGAGAAATATGAAACTAACGTT<br>GGGTCCCAGGGGTCTCAACTCTCTAGAGGGGAGAAACAA<br>CGCATTGCTATTGCTCGGGCCATTGTACGAGATCCTAAAA<br>TCTTGCTACTAGATGAAGCCACTTCTGCCTTAGACACAGA<br>AAGTGAAAAGACGGTGCAGGTTGCTCTAGACAAAGCCAG<br>AGAGGGTCGGACCTGCATTGTCATTGCCCATCGCTTGTCC<br>ACCATCCAGAACGCGGATATCATTGCTGTCATGGCACAG<br>GGGGTGGTGATTGAAAAGGGGACCCATGAAGAACTGATG<br>GCCCAAAAAGGAGCCTACTACAAACTAGTCACCACTGGA<br>TCCCCCATCAGTTGACCCAATGCAAGAATCTCAGACACAC<br>ATGACGCACCAGTTACAGGGGTTGTTTTTAAAGAAAAAA<br>ACAATCCCAGCAGGAGGGATTGCTGGGATTGTTTTTCTT<br>TAAAGAAGAATGTTAATATTTTACTTTTACAGTCATTTTC<br>CTACATCGGAATCCAAGCTAATTTCTAATGGCCTTCCATA<br>ATAATTCTGCTTTAGATGTGTATACAGAAAATGAAAGAA<br>ACTAGGGTCCATATGAGGGAAAACCCAATGTCAAGTGGC<br>AGCTCAGCCACCACTCAGTGCTTCTCTGTGCAGGAGCCAG<br>TCCTGATTAATATGTGGGAATTAGTGAGACATCAGGGAG<br>TAAGTGACACTTTGAACTCCTCAAGGGCAGAGAACTGTCT<br>TTCATTTTTGAACCCTCGGTGTACACAGAGGCGGGTCTAT<br>AACAGGCAATCAACAAACGTTTCTTGAGCTAGACCAAGG<br>TCAGATTTGAAAAGAACAGAAGGACTGAAGACCAGCTGT<br>GTTTCTTAACTAAATTTGTCTTTCAAGTGAAACCAGCTTC<br>CTTCATCTCTAAGGCTAAGGATAGGGAAAGGGTGGATGC<br>TCTCAGGCTGAGGGAGGCAGAAAGGGAAAGTATTAGCAT<br>GAGCTTTCCAGTTAGGGCTGTTGATTTATGCTTTAACTTC<br>AGAGTGAGTGTAGGGGTGGTGATGCT |
| ABCB11 bile<br>salt exporter<br>protein Homo<br>sapiens<br>SEQ ID NO:<br>115 | MSDSVILRSIKKFGEENDGFESDKSYNNDKKSRLQDEKKGD<br>GVRVGFFQLFRFSSSTDIWLMFVGSLCAFLHGIAQPGVLLIF<br>GTMTDVFIDYDVELQELQIPGKACVNNTIVWTNSSLNQNMT<br>NGTRCGLLNIESEMIKFASYYAGIAVAVLITGYIQICFWVIAA<br>ARQIQKMRKFYFRRIMRMEIGWFDCNSVGELNTRFSDDINKI<br>NDAIADQMALFIQRMTSTICGFLLGFFRGWKLTLVIISVSPLI<br>GIGAATIGLSVSKFTDYELKAYAKAGVVADEVISSMRTVAA<br>FGGEKREVERYEKNLVFAQRWGIRKGIVMGFFTGFVWCLIF<br>LCYALAFWYGSTLVLDEGEYTPGTLVQIFLSVIVGALNLGN<br>ASPCLEAFATGRAAATSIFETIDRKPIIDCMSEDGYKLDRIKG<br>EIEFHNVTFHYPSRPEVKILNDLNMVIKPGEMTALVGPSGAG<br>KSTALQLIQRFYDPCEGMVTVDGHDIRSLNIQWLRDQIGIVE<br>QEPVLFSTTIAENIRYGREDATMEDIVQAAKEANAYNFIMDL<br>PQQFDTLVGEGGGQMSGGQKQRVAIARALIRNPKILLLDMA<br>TSALDNESEAMVQEVLSKIQHGHTIISVAHRLSTVRAADTIIG<br>FEHGTAVERGTHEELLERKGVYFTLVTLQSQGNQALNEEDI<br>KDATEDDMLARTFSRGSYQDSLRASIRQRSKSQLSYLVHEPP<br>LAVVDHKSTYEEDRKDKDIPVQEEVEPAPVRRILKFSAPEWP<br>YMLVGSVGAAVNGTVTPLYAFLFSQILGTFSIPDKEEQRSQI<br>NGVCLLFVAMGCVSLFTQFLQGYAFAKSGELLTKRLRKFGF<br>RAMLGQDIAWFDDLRNSPGALTTRLATDASQVQGAAGSQI<br>GMIVNSFTNVTVAMIIAFSFSWKLSLVILCFPPFLALSGATQT<br>RMLTGFASRDKQALEMVGQITNEALSNIRTVAGIGKERRFIE<br>ALETELEKPFKTAIQKANIYGFCFAFAQCIMFIANSASYRYG<br>GYLISNEGLHFSYVFRVISAVVLSATALGRAFSYTPSYAKAK<br>ISAARFFQLLDRQPPISVYNTAGEKWDNFQGKIDFVDCKFTY<br>PSRPDSQVLNGLSVSISPGQTLAFVGSSGCGKSTSIQLLERFY<br>DPDQGKVMIDGHDSKKVNVQFLRSNIGIVSQEPVLFACSIM<br>DNIKYGDNTKEIPMERVIAAAKQAQLHDFVMSLPEKYETNV<br>GSQGSQLSRGEKQRIAIARAIVRDPKILLLDEATSALDTESEK<br>TVQVALDKAREGRTCIVIAHRLSTIQNADIIAVMAQGVVIEK<br>GTHEELMAQKGAYYKLVTTGSPIS |

TABLE 12-continued

Bile Salt Transport and Export Sequences

| Description | Sequence |
|---|---|
| *Streptococcus thermophilus* Msba subfamily ABC transporter ATP-binding protein STH8232_1633 SEQ ID NO: 116 | MEGRTVFVIAHRLSTIVNSDVILVMDHGRIIKRGDHDTLMEQ GGTYYRLYTGSLEID |
| *Nostoc* spp. Asl1293 ABC transporter gene SEQ ID NO: 117 | ATGTGGGGGAAACAAAGACAAAGAATCGCCATTGCACGA GGGGGTTTTAAGAATTTGCAGGTTTTGATTTTAGATAAAG CAACCTCGGCATTGGATAATAAAACAGAAGCAGCTATTG AGCGATCGCTGGTGTTGACTGTTGACCAATGA |
| *Nostoc* spp. Asl1293 ABC transporter protein SEQ ID NO: 118 | MWGKQRQRIAIARGGFKNLQVLILDKATSALDNKTEAAIER SLVLTVDQ |
| *Neisseria meningitides* (MC58) ASBT$_{NM}$ bile acid sodium symporter (NMB0705) SEQ ID NO: 119 | ATGAATATCCTCAGTAAAATCAGCAGCTTTATCGGAAAA ACATTTTCCCTCTGGGCCGCGCTCTTTGCCGCCGCCGCTTT TTTCGCGCCCGACACCTTCAAATGGGCGGGGCCTTATATT CCTTGGCTGTTGGGCATTATTATGTTCGGTATGGGTTTGA CGCTCAAACCTTCCGACTTCGATATTTTGTTCAAACATCC CAAAGTCGTCATCATCGGCGTAATCGCACAATTCGCCATT ATGCCGGCAACCGCCTGGCTGCTGTCCAAACTGTTGAACC TGCCTGCCGAAATCGCGGTCGGCGTGATTTTGGTCGGCTG CTGCCCGGGCGGTACGGCTTCCAATGTGATGACCTATCTG GCGCGTGGCAATGTGGCTTTGTCGGTTGCCGTTACGTCTG TTTCCACCCTGATTTCCCCATTGCTGACTCCCGCCATCTTC CTGATGCTTGCCGGCGAAATGCTGGAAATCCAAGCGGCC GGTATGTTGATGTCCATCGTCAAAATGGTTTTGCTCCCCA TTGTTTTGGGTTTGATTGTCCATAAGGTTTTGGGCAGTAA AACCGAAAAGCTGACCGATGCGCTGCCGCTGGTTTCCGTT GCCGCCATCGTGCTGATTATCGGCGCGGTTGTTGGGGCAA GCAAAGGCAAGATTATGGAAAGCGGCCTGCTGATTTTTG CGGTTGTCGTACTCCACAACGGCATCGGCTACCTGCTCGG CTTCTTTGCCGCCAAATGGACCGGCCTGCCTTATGATGCA CAAAAAACGCTGACCATCGAAGTCGGTATGCAAAACTCG GGCCTGGCCGCCGCGCTTGCCGCCGCACACTTTGCCGCCG CGCCGGTCGTTGCCGTTCCGGGCGCATTGTTCAGCGTGTG GCACAATATCTCCGGCTCGCTGCTGGCAACTTATTGGGCG GCCAAAGCCGGTAAACATAAAAAACCCTAA |
| *Neisseria meningitides* (MC58) ASBT$_{NM}$ bile acid sodium symporter protein SEQ ID NO: 120 | MNILSKISSFIGKTFSLWAALFAAAAFFAPDTFKWAGPYIPW LLGIIMFGMGLTLKPSDFDILFKHPKVVIIGVIAQFAIMPATA WLLSKLLNLPAEIAVGVILVGCCPGGTASNVMTYLARGNVA LSVAVTSVSTLISPLLTPAIFLMLAGEMLEIQAAGMLMSIVK MVLLPIVLGLIVHKVLGSKTEKLTDALPLVSVAAIVLIIGAVV GASKGKIMESGLLIFAVVVLHNGIGYLLGFFAAKWTGLPYD AQKTLTIEVGMQNSGLAAALAAAHFAAAPVVAVPGALFSV WHNISGSLLATYWAAKAGKHKKPGSENLYFQ |

In one embodiment, the bile salt transporter is the bile salt importer CbsT1. In one embodiment, the cbsT1 gene has at least about 80% identity to SEQ ID NO: 110. Accordingly, in one embodiment, the cbsT1 gene has at least about 90% identity to SEQ ID NO: 110. Accordingly, in one embodiment, the cbsT1 gene has at least about 95% identity to SEQ ID NO: 110. Accordingly, in one embodiment, the cbsT1 gene has at least about 85%, 86%, 87%, 88%, 89%, 90%, 91%, 92%, 93%, 94%, 95%, 96%, 97%, 98%, or 99% identity to SEQ ID NO: 110. In another embodiment, the cbsT1 gene comprises the sequence of SEQ ID NO: 110. In yet another embodiment the cbsT1 gene consists of the sequence of SEQ ID NO: 110.

In one embodiment, the bile salt transporter is the bile salt importer CbsT2. In one embodiment, the cbsT2 gene has at least about 80% identity to SEQ ID NO: 112. Accordingly, in one embodiment, the cbsT2 gene has at least about 90% identity to SEQ ID NO: 112. Accordingly, in one embodiment, the cbsT2 gene has at least about 95% identity to SEQ ID NO: 112. Accordingly, in one embodiment, the cbsT2 gene has at least about 85%, 86%, 87%, 88%, 89%, 90%, 91%, 92%, 93%, 94%, 95%, 96%, 97%, 98%, or 99% identity to SEQ ID NO: 112. In another embodiment, the cbsT2 gene comprises the sequence of SEQ ID NO: 112. In yet another embodiment the cbsT2 gene consists of the sequence of SEQ ID NO: 112.

In one embodiment, the bile acid transporter is the bile acid sodium symporter $ASBT_{NM}$. In one embodiment, the NMB0705 gene of *Neisseria meningitides* has at least about 80% identity to SEQ ID NO: 117. Accordingly, in one embodiment, the NMB0705 gene has at least about 90% identity to SEQ ID NO: 117. Accordingly, in one embodiment, the NMB0705 gene has at least about 95% identity to SEQ ID NO: 117. Accordingly, in one embodiment, the NMB0705 gene has at least about 85%, 86%, 87%, 88%, 89%, 90%, 91%, 92%, 93%, 94%, 95%, 96%, 97%, 98%, or 99% identity to SEQ ID NO: 117. In another embodiment, the NMB0705 gene comprises the sequence of SEQ ID NO: 117. In yet another embodiment the NMB0705 gene consists of the sequence of SEQ ID NO: 117.

In one embodiment, one or more polypeptides encoded by the and expressed by the genetically engineered bacteria have at least about 80% identity with one or more of SEQ ID NO: 111, 113, 115, 116, 118 and 120. In another embodiment, one or more polypeptides encoded by the propionate circuits and expressed by the genetically engineered bacteria have at least about 85% identity with one or more of SEQ ID NO: 111, 113, 115, 116, 118 and 120. In one embodiment, one or more polypeptides encoded by the propionate circuits and expressed by the genetically engineered bacteria have at least about 90% identity with one or more of SEQ ID NO: 111, 113, 115, 116, 118 and 120. In one embodiment, one or more polypeptides encoded by the propionate circuits and expressed by the genetically engineered bacteria have at least about 95% identity with one or more of SEQ ID NO: 111, 113, 115, 116, 118 and 120. In another embodiment, one or more polypeptides encoded by the propionate circuits and expressed by the genetically engineered bacteria have at least about 96%, 97%, 98%, or 99% identity with one or more of SEQ ID NO: 111, 113, 115, 116, 118 and 120. Accordingly, in one embodiment, one or more polypeptides encoded by the propionate circuits and expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with with one or more of SEQ ID NO: 111, 113, 115, 116, 118 and 120. In another embodiment, one or more polypeptides encoded by the propionate circuits and expressed by the genetically engineered bacteria one or more polypeptides encoded by the propionate circuits and expressed by the genetically engineered bacteria comprise the sequence of with one or more of SEQ ID NO: 111, 113, 115, 116, 118 and 120. In yet another embodiment one or more polypeptides encoded by the propionate circuits and expressed by the genetically engineered bacteria consist of the sequence of with one or more of SEQ ID NO: 111, 113, 115, 116, 118 and 120.

In some embodiments, the bacterial cell comprises a heterologous gene encoding a bile salt hydrolase enzyme operably linked to a first promoter and a heterologous gene encoding a transporter of a bile salt. In some embodiments, the heterologous gene encoding a transporter of the bile salt is operably linked to the first promoter. In other embodiments, the heterologous gene encoding a transporter of the bile salt is operably linked to a second promoter. In one embodiment, the gene encoding a transporter of the bile salt is directly operably linked to the second promoter. In another embodiment, the gene encoding a transporter of the bile salt is indirectly operably linked to the second promoter.

In some embodiments, expression of a gene encoding a transporter of a bile salt is controlled by a different promoter than the promoter that controls expression of the gene encoding the bile salt hydrolase enzyme. In some embodiments, expression of the gene encoding a transporter of a bile salt is controlled by the same promoter that controls expression of the bile salt hydrolase enzyme. In some embodiments, a gene encoding a transporter of a bile salt and the bile salt hydrolase enzyme are divergently transcribed from a promoter region. In some embodiments, expression of each of genes encoding the gene encoding a transporter of a bile salt and the gene encoding the bile salt hydrolase enzyme is controlled by different promoters.

In one embodiment, the gene encoding a transporter of a bile salt is not operably linked with its natural promoter. In some embodiments, the gene encoding the transporter of the bile salt is controlled by its native promoter. In some embodiments, the gene encoding the transporter of the bile salt is controlled by an inducible promoter. In some embodiments, the gene encoding the transporter of the bile salt is controlled by a promoter that is stronger than its native promoter. In some embodiments, the gene encoding the transporter of the bile salt is controlled by a constitutive promoter.

In another embodiment, the promoter is an inducible promoter. Inducible promoters are described in more detail infra.

In one embodiment, the gene encoding a transporter of a bile salt is located on a plasmid in the bacterial cell. In another embodiment, the gene encoding a transporter of a bile salt is located in the chromosome of the bacterial cell. In yet another embodiment, a native copy of the gene encoding a transporter of a bile salt is located in the chromosome of the bacterial cell, and a copy of a gene encoding a transporter of a bile salt from a different species of bacteria is located on a plasmid in the bacterial cell. In yet another embodiment, a native copy of the gene encoding a transporter of a bile salt is located on a plasmid in the bacterial cell, and a copy of a gene encoding a transporter of a bile salt from a different species of bacteria is located on a plasmid in the bacterial cell. In yet another embodiment, a native copy of the gene encoding a transporter of a bile salt is located in the chromosome of the bacterial cell, and a copy of the gene encoding a transporter of a bile salt from a different species of bacteria is located in the chromosome of the bacterial cell.

In some embodiments, the at least one native gene encoding the transporter of a bile salt in the bacterial cell is not modified, and one or more additional copies of the native transporter of a bile salt are inserted into the genome. In one embodiment, the one or more additional copies of the native transporter that is inserted into the genome are under the control of the same inducible promoter that controls expression of the gene encoding the bile salt hydrolase enzyme, e.g., the FNR responsive promoter, or a different inducible promoter than the one that controls expression of the bile salt hydrolase enzyme, or a constitutive promoter. In alternate embodiments, the at least one native gene encoding the transporter is not modified, and one or more additional copies of the transporter from a different bacterial species is inserted into the genome of the bacterial cell. In one embodiment, the one or more additional copies of the transporter inserted into the genome of the bacterial cell are under the control of the same inducible promoter that controls expression of the gene encoding the bile salt hydrolase enzyme, e.g., the FNR responsive promoter, or a different inducible promoter than the one that controls expression of the gene encoding the bile salt hydrolase enzyme, or a constitutive promoter.

In one embodiment, when the transporter of a bile salt is expressed in the recombinant bacterial cells, the bacterial cells import 10% more bile salt into the bacterial cell when the transporter is expressed than unmodified bacteria of the same bacterial subtype under the same conditions. In another embodiment, when the transporter of a bile salt is expressed in the recombinant bacterial cells, the bacterial cells import 20%, 30%, 40%, 50%, 60%, 70%, 80%, 90% or 100% more bile salt into the bacterial cell when the transporter is expressed than unmodified bacteria of the same bacterial subtype under the same conditions. In yet another embodiment, when the transporter of a bile salt is expressed in the recombinant bacterial cells, the bacterial cells import two-fold more bile salt into the cell when the transporter is expressed than unmodified bacteria of the same bacterial subtype under the same conditions. In yet another embodiment, when the transporter of a bile salt is expressed in the recombinant bacterial cells, the bacterial cells import three-fold, four-fold, five-fold, six-fold, seven-fold, eight-fold, nine-fold, or ten-fold more bile salt into the cell when the transporter is expressed than unmodified bacteria of the same bacterial subtype under the same conditions.

Generation of Bacterial Strains with Enhanced Ability to Transport Bile Salts

Due to their ease of culture, short generation times, very high population densities and small genomes, microbes can be evolved to unique phenotypes in abbreviated timescales. Adaptive laboratory evolution (ALE) is the process of passaging microbes under selective pressure to evolve a strain with a preferred phenotype. Most commonly, this is applied to increase utilization of carbon/energy sources or adapting a strain to environmental stresses (e.g., temperature, pH), whereby mutant strains more capable of growth on the carbon substrate or under stress will outcompete the less adapted strains in the population and will eventually come to dominate the population.

This same process can be extended to any essential metabolite by creating an auxotroph. An auxotroph is a strain incapable of synthesizing an essential metabolite and must therefore have the metabolite provided in the media to grow. In this scenario, by making an auxotroph and passaging it on decreasing amounts of the metabolite, the resulting dominant strains should be more capable of obtaining and incorporating this essential metabolite.

For example, if the biosynthetic pathway for producing an amino acid is disrupted a strain capable of high-affinity capture of said amino acid can be evolved via ALE. First, the strain is grown in varying concentrations of the auxotrophic amino acid, until a minimum concentration to support growth is established. The strain is then passaged at that concentration, and diluted into lowering concentrations of the amino acid at regular intervals. Over time, cells that are most competitive for the amino acid—at growth-limiting concentrations—will come to dominate the population. These strains will likely have mutations in their amino acid-transporters resulting in increased ability to import the essential and limiting amino acid.

Similarly, by using an auxotroph that cannot use an upstream metabolite to form an amino acid, a strain can be evolved that not only can more efficiently import the upstream metabolite, but also convert the metabolite into the essential downstream metabolite. These strains will also evolve mutations to increase import of the upstream metabolite, but may also contain mutations which increase expression or reaction kinetics of downstream enzymes, or that reduce competitive substrate utilization pathways.

A metabolite innate to the microbe can be made essential via mutational auxotrophy and selection applied with growth-limiting supplementation of the endogenous metabolite. However, phenotypes capable of consuming non-native compounds can be evolved by tying their consumption to the production of an essential compound. For example, if a gene from a different organism is isolated which can produce an essential compound or a precursor to an essential compound this gene can be recombinantly introduced and expressed in the heterologous host. This new host strain will now have the ability to synthesize an essential nutrient from a previously non-metabolizable substrate. Hereby, a similar ALE process can be applied by creating an auxotroph incapable of converting an immediately downstream metabolite and selecting in growth-limiting amounts of the non-native compound with concurrent expression of the recombinant enzyme. This will result in mutations in the transport of the non-native substrate, expression and activity of the heterologous enzyme and expression and activity of downstream native enzymes. It should be emphasized that the key requirement in this process is the ability to tether the consumption of the non-native metabolite to the production of a metabolite essential to growth.

Once the basis of the selection mechanism is established and minimum levels of supplementation have been established, the actual ALE experimentation can proceed. Throughout this process several parameters must be vigilantly monitored. It is important that the cultures are maintained in an exponential growth phase and not allowed to reach saturation/stationary phase. This means that growth rates must be check during each passaging and subsequent dilutions adjusted accordingly. If growth rate improves to such a degree that dilutions become large, then the concentration of auxotrophic supplementation should be decreased such that growth rate is slowed, selection pressure is increased and dilutions are not so severe as to heavily bias subpopulations during passaging. In addition, at regular intervals cells should be diluted, grown on solid media and individual clones tested to confirm growth rate phenotypes observed in the ALE cultures.

Predicting when to halt the stop the ALE experiment also requires vigilance. As the success of directing evolution is tied directly to the number of mutations "screened" throughout the experiment and mutations are generally a function of errors during DNA replication, the cumulative cell divisions (CCD) acts as a proxy for total mutants which have been screened. Previous studies have shown that beneficial phenotypes for growth on different carbon sources can be isolated in about $10^{11.2}$ CCD[1]. This rate can be accelerated by the addition of chemical mutagens to the cultures—such as N-methyl-N-nitro-N-nitrosoguanidine (NTG)—which causes increased DNA replication errors. However, when continued passaging leads to marginal or no improvement in growth rate the population has converged to some fitness maximum and the ALE experiment can be halted.

At the conclusion of the ALE experiment, the cells should be diluted, isolated on solid media and assayed for growth phenotypes matching that of the culture flask. Best performers from those selected are then prepped for genomic DNA and sent for whole genome sequencing. Sequencing with reveal mutations occurring around the genome capable of providing improved phenotypes, but will also contain silent mutations (those which provide no benefit but do not detract from desired phenotype). In cultures evolved in the presence of NTG or other chemical mutagen, there will be significantly more silent, background mutations. If satisfied with the best performing strain in its current state, the user can proceed to application with that strain. Otherwise the contributing mutations can be deconvoluted from the evolved strain by reintroducing the mutations to the parent strain by genome engineering techniques. See Lee, D.-H., Feist, A. M., Barrett, C. L. & Palsson, B. Ø. Cumulative Number of Cell Divisions as a Meaningful Timescale for Adaptive Laboratory Evolution of *Escherichia coli*. PLoS ONE 6, e26172 (2011).

Similar methods can be used to generate *E. coli* Nissle mutants that consume bile salts and/or over-produce bile salt hydrolase.

Exporters of Bile Salts

The export of bile salts is mediated by proteins well known to those of skill in the art. For example, the ATP-binding cassette, sub-family B member 11 (ABCB11, also called BSEP or "bile salt export pump") is responsible for the export of taurochoate and other cholate conjugates from hepatocytes to the bile in mammals, and mutations in this gene have been associated with progressive familial intrahepatic cholestasis type 2 (PFIC2) and hepatocellular carcinoma (see Strautnieks et al., *Nature Genetics*, 20(3):233-238, 1998; Knisely et al., *Hepatology*, 44(2):478-486, 2006; and Ho et al., *Pharmacogenet. Genomics*, 20(1):45-57, 2010; SEQ ID NO: 113 and SEQ ID NO:114). In bacteria, *Streptococcus thermophilus* comprises a bile salt export pump (Msba subfamily ABC transporter ATP-binding protein; accession F8LYG6; SEQ ID NO: 116), and *Nostoc* spp. are known to comprise a bile salt export pump (As11293; accession Q8YXC2; SEQ ID NO: 117 and SEQ ID NO: 118). Multiple other bile salt exporters are known in the art.

Thus, in one embodiment of the invention, when the recombinant bacterial cell comprises an endogenous bile salt exporter gene, the recombinant bacterial cells may comprise a genetic modification that reduces export of one or more bile salts from the bacterial cell. In another embodiment, the recombinant bacterial cell comprises a genetic modification that reduces export of one or more bile salts from the bacterial cell and a heterologous gene encoding a bile salt catabolism enzyme. When the recombinant bacterial cells comprise a genetic modification that reduces export of a bile salt, the bacterial cells retain more bile salts in the bacterial cell than unmodified bacteria of the same bacterial subtype under the same conditions. Thus, the recombinant bacteria comprising a genetic modification that reduces export of a bile salt may be used to retain more bile salts in the bacterial cell so that any bile salt catabolism enzyme expressed in the organism can catabolize the bile salt(s) to treat diseases associated with bile salts, including cardiovascular disease. In one embodiment, the recombinant bacteria further comprise a heterologous gene encoding a transporter of one or more bile salts.

In one embodiment, the recombinant bacterial cell comprises a genetic modification in a gene encoding a bile salt exporter wherein said bile salt exporter comprises an amino acid sequence that has at least 80%, 81%, 82%, 83% 84%, 85%, 86%, 87%, 88%, 89%, 90%, 91%, 92%, 93%, 94%, 95%, 96%, 97%, 98%, 99%, or 100% identity to the amino acid sequence of a polypeptide encoded by a bile salt exporter gene disclosed herein. In one embodiment, the bile salt exporter has at least 80%, 81%, 82%, 83% 84%, 85%, 86%, 87%, 88%, 89%, 90%, 91%, 92%, 93%, 94%, 95%, 96%, 97%, 98%, 99%, or 100% identity to the amino acid sequence of SEQ ID NO: 115. In another embodiment, the bile salt exporter has at least 80%, 81%, 82%, 83% 84%, 85%, 86%, 87%, 88%, 89%, 90%, 91%, 92%, 93%, 94%, 95%, 96%, 97%, 98%, 99%, or 100% identity to the nucleotide sequence of SEQ ID NO: 117.

In one embodiment, the genetic modification reduces export of a bile salt from the bacterial cell. In one embodiment, the bacterial cell is from a bacterial genus or species that includes but is not limited to, *Streptococcus thermophilus* or *Nostoc* spp.

In one embodiment, the genetic modification is a mutation in an endogenous gene encoding an exporter of one or more bile salts. In one embodiment, the genetic mutation results in an exporter having reduced activity as compared to a wild-type exporter protein. In one embodiment, the activity of the exporter is reduced at least 50%, at least 75%, or at least 100%. In another embodiment, the activity of the exporter is reduced at least two-fold, three-fold, four-fold, or five-fold. In another embodiment, the genetic mutation results in an exporter having no activity, i.e., results in an exporter which cannot export one or more bile salts from the bacterial cell.

It is routine for one of ordinary skill in the art to make mutations in a gene of interest. Mutations include substitutions, insertions, deletions, and/or truncations of one or more specific amino acid residues or of one or more specific nucleotides or codons in the polypeptide or polynucleotide of the exporter of an amino acid. Mutagenesis and directed evolution methods are well known in the art for creating variants. See, e.g., U.S. Pat. Nos. 7,783,428; 6,586,182; 6,117,679; and Ling, et al., 1999, "Approaches to DNA mutagenesis: an overview," *Anal. Biochem.*, 254(2):157-78; Smith, 1985, "In vitro mutagenesis," *Ann. Rev. Genet.*, 19:423-462; Carter, 1986, "Site-directed mutagenesis," *Biochem. J.*, 237:1-7; and Minshull, et al., 1999, "Protein evolution by molecular breeding," *Current Opinion in Chemical Biology*, 3:284-290. For example, the lambda red system can be used to knock-out genes in *E. coli* (see, for example, Datta et al., *Gene*, 379:109-115 (2006)).

The term "inactivated" as applied to a gene refers to any genetic modification that decreases or eliminates the expression of the gene and/or the functional activity of the corresponding gene product (mRNA and/or protein). The term "inactivated" encompasses complete or partial inactivation, suppression, deletion, interruption, blockage, promoter alterations, antisense RNA, dsRNA, or down-regulation of a gene. This can be accomplished, for example, by gene "knockout," inactivation, mutation (e.g., insertion, deletion, point, or frameshift mutations that disrupt the expression or activity of the gene product), or by use of inhibitory RNAs (e.g., sense, antisense, or RNAi technology). A deletion may encompass all or part of a gene's coding sequence. The term "knockout" refers to the deletion of most (at least about 95%, at least about 96%, at least about 97%, at least about 98%, or at least about 99%) or all (100%) of the coding sequence of a gene. In some embodiments, any number of nucleotides can be deleted, from a single base to an entire piece of a chromosome.

Assays for testing the activity of an exporter of one or more bile salts are well known to one of ordinary skill in the art. For example, export of one or more bile salts may be determined using the methods described by Telbisz and Homolya, *Expert Opinion Ther. Targets*, 1-14, 2015, the entire contents of which are expressly incorporated herein by reference.

In another embodiment, the genetic modification is a mutation in a promoter of an endogenous gene encoding an exporter of one or more bile salts. In one embodiment, the genetic mutation results in decreased expression of the exporter gene. In one embodiment, exporter gene expression is reduced by about 50%, 75%, or 100%. In another embodiment, exporter gene expression is reduced about two-fold, three-fold, four-fold, or five-fold. In another embodiment, the genetic mutation completely inhibits expression of the exporter gene.

Assays for testing the level of expression of a gene, such as an exporter of one or more bile salts are well known to one of ordinary skill in the art. For example, reverse-transcriptase polymerase chain reaction may be used to detect the level of mRNA expression of a gene. Alternatively, Western blots using antibodies directed against a protein may be used to determine the level of expression of the protein.

In another embodiment, the genetic modification is an overexpression of a repressor of an exporter of one or more bile salts. In one embodiment, the overexpression of the repressor of the exporter is caused by a mutation which renders the promoter of the repressor constitutively active. In another embodiment, the overexpression of the repressor of the exporter is caused by the insertion of an inducible promoter in front of the repressor so that the expression of the repressor can be induced. Inducible promoters are described in more detail herein.

In one embodiment, the recombinant bacterial cells described herein comprise at least one genetic modification that reduces export of one or more bile salts from the bacterial cell. In another embodiment, the recombinant bacterial cells described herein comprise two genetic modifications that reduce export of one or more bile salts from the bacterial cell. In another embodiment, the recombinant bacterial cells described herein comprise three genetic modifications that reduce export of one or more bile salts from the bacterial cell. In another embodiment, the recombinant bacterial cells described herein comprise four genetic modifications that reduce export of one or more bile salts from the bacterial cell. In another embodiment, the recombinant bacterial cells described herein comprise five genetic modifications that reduce export of one or more bile salts from the bacterial cell.

Tryptophan, Tryptophan Metabolism, and Tryptophan Metabolites

Tryptophan (TRP) is an essential amino acid that, after consumption, is either incorporated into proteins via new protein synthesis, or converted a number of biologically active metabolites with a number of differing roles in health and disease (Perez-De La Cruz et al., 2007 Kynurenine Pathway and Disease: An Overview; CNS & Neurological Disorders—Drug Targets 2007, 6, 398-410). Along one arm of tryptophan catabolism, trytophan is converted to the neurotransmitter serotonin (5-hydroxytryptamine, 5-HT) in select populations of neurons by tryptophan hydroxylase. Serotonin can further be converted into the hormone melatonin. The majority of tryptophan, approximately 95%, however, is metabolized to a number of bioactive metabolites, collectively called kynurenines, along a second arm called the kynurenine pathway (KP). In the first step of catabolism, TRP is converted to Kynurenine, (KYN), which has well-documented immune suppressive functions in several types of immune cells, and has recently been shown to be an activating ligand for the arylcarbon receptor (AhR; also known as dioxin receptor).

AhR is a ligand-dependent cytosolic transcription factor that is able to translocate to the cell nucleus after ligand binding. The in additional to kynurenine, tryptophan metabolites L-kynurenine, 6-formylindolcarbazole (FICZ, a photoproduct of TRP), and KYNA are have recently been identified as endogenous AhR ligands mediating immunosuppressive functions. To induce transcription of AhR target genes in the nucleus, AhR partners with proteins such as AhR nuclear translocator (ARNT) or NF-κB subunit RelB. Studies on human cancer cells have shown that KYN activates the AhR-ARNT associated transcription of IL-6, which induced autocrine activation of IDO1 via STAT3. This AhR-IL-6-STAT3 loop is associated with a poor prognosis in lung cancer, supporting the idea that IDO/kynurenine-mediated immunosuppression enables the immune escape of tumor cells.

Figure 32A:
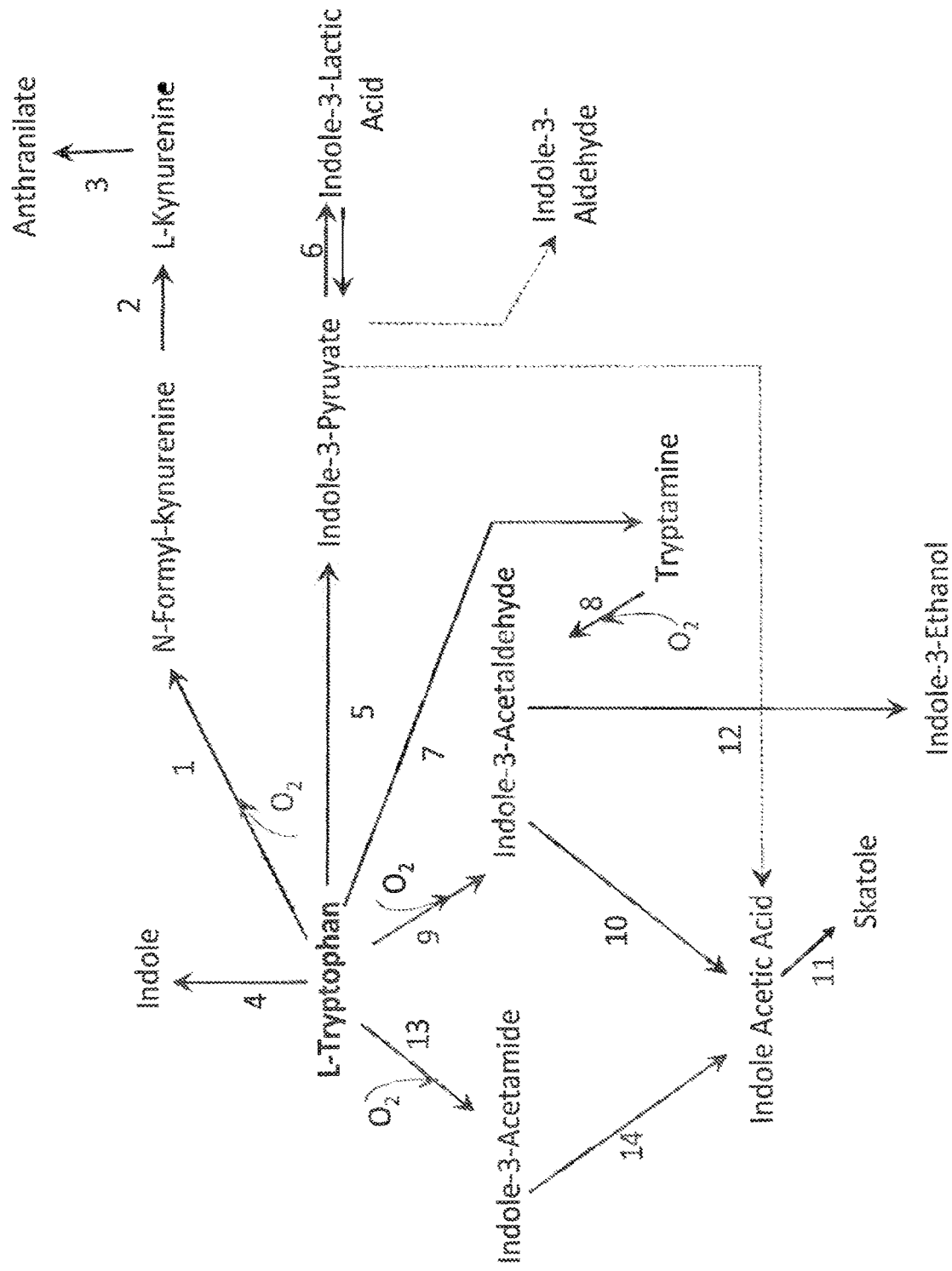
FIG. 32A depicts a schematic of the bacterial tryptophan metabolism, as described, e.g., in Enzymes are numbered as follows 1) Trp 2,3 dioxygenase (EC 1.13.11.11); 2) kynurenine formidase (EC 3.5.1.49); 3) kynureninase (EC 3.7.1.3); 4) tryptophanase (EC 4.1.99.1); 5) Trp aminotransferase (EC 2.6.1.27); 6) indole lactate dehydrogenase (EC1.1.1.110); 7) Trp decarboxylase (EC 4.1.1.28); 8) tryptamine oxidase (EC 1.4.3.4); 9) Trp side chain oxidase (EC 4.1.1.43); 10) indole acetaldehyde dehydrogenase (EC 1.2.1.3); 11) indole acetic acid oxidase; 13) Trp 2-monooxygenase (EC 1.13.12.3); and 14) indole acetamide hydrolase (EC 3.5.1.0). The dotted lines (--) indicate a spontaneous reaction. In certain embodiments of the disclosure, the genetically engineered bacteria comprise gene cassettes comprising one or more of the bacterial tryptophan metabolism enzymes depicted in FIG. 32. In certain embodiments, the genetically engineered bacteria comprise one or more gene cassettes which produce one or more of the metabolites depicted in FIG. 32. In certain embodiments, the one or more cassettes are on a plasmid; in other embodiments, the cassettes are integrated into the genome. In certain embodiments the one or more cassettes are under the control of inducible promoters which are induced under low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose.
Figure 32B:
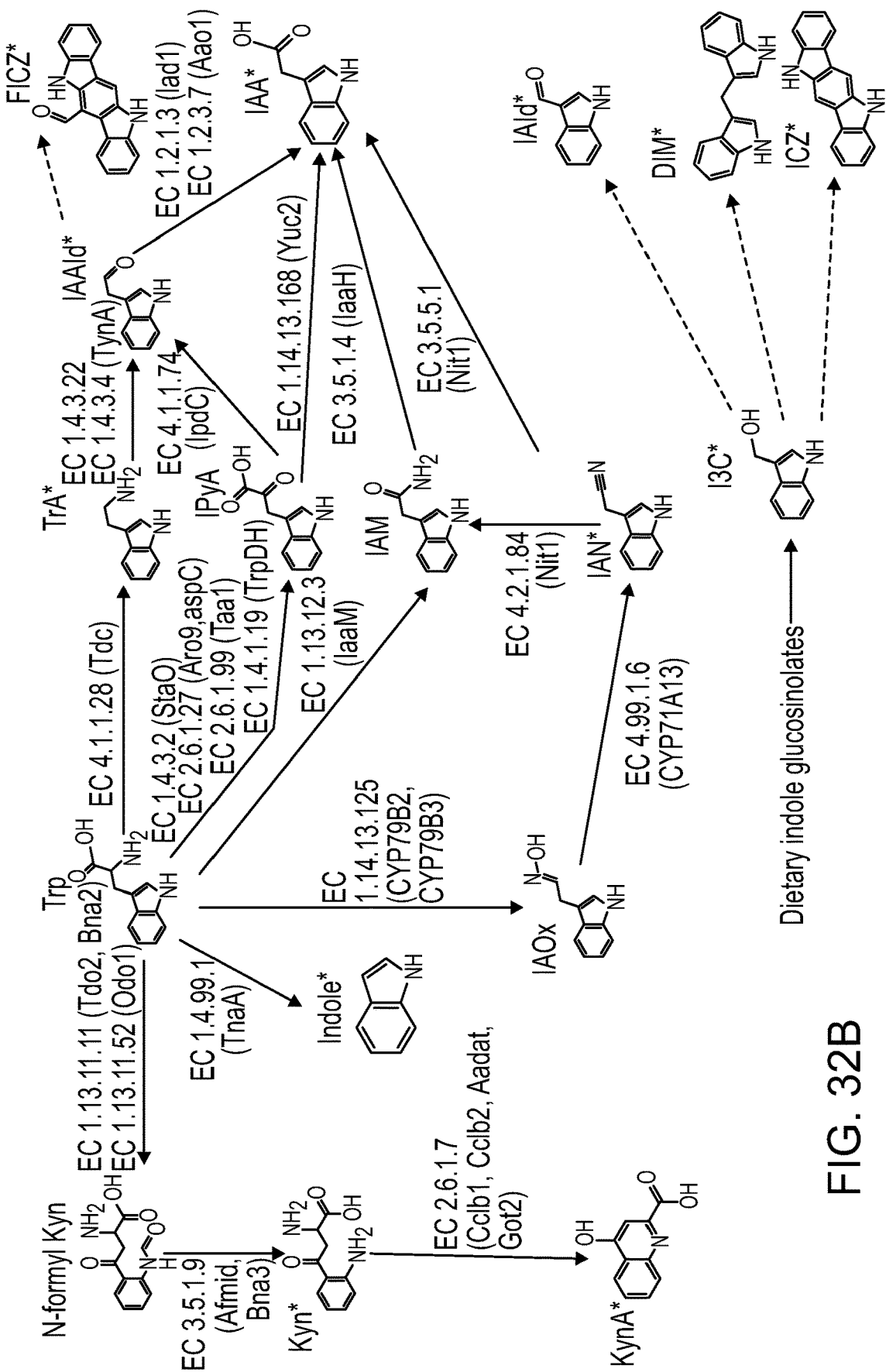
FIG. 32B Depicts a schematic of tryptophan derived pathways. Known AHR agonists are with asterisk. Abbreviations are as follows. Trp: Tryptophan; TrA: Tryptamine; IAAld: Indole-3-acetaldehyde; IAA: Indole-3-acetic acid; FICZ: 6-formylindolo(3,2-b)carbazole; IPyA: Indole-3-pyruvic acid; IAM: Indole-3-acetamine; IAOx: Indole-3-acetaldoxime; IAN: Indole-3-acetonitrile; N-formyl Kyn: N-formylkynurenine; Kyn: Kynurenine; KynA: Kynurenic acid; I3C: Indole-3-carbinol; IAld: Indole-3-aldehyde; DIM: 3,3'-Diindolylmethane; ICZ: Indolo(3,2-b)carbazole.
Figure 33:
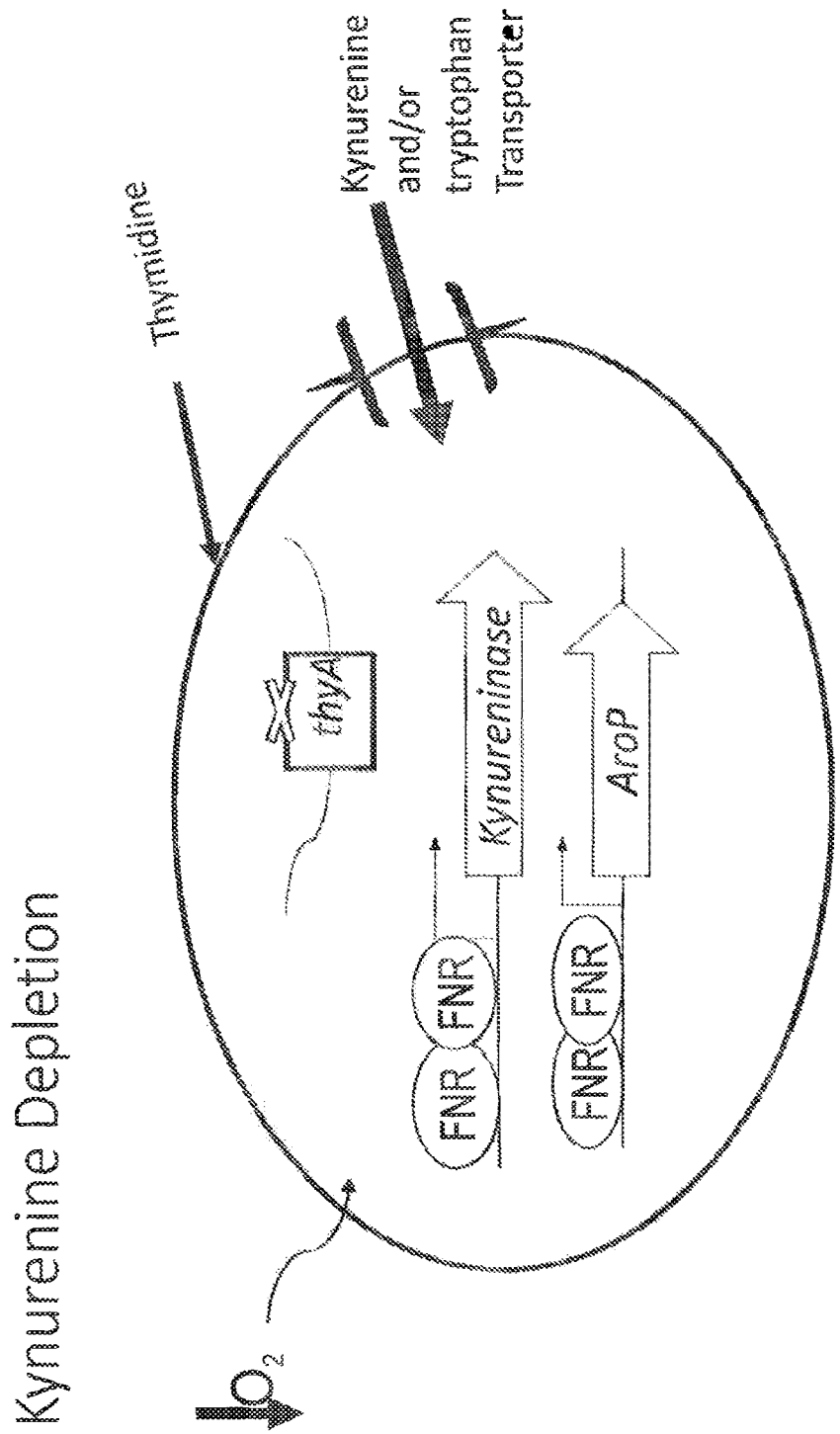
FIG. 33 depicts a schematic showing an exemplary Kynurenine Degradation Circuit. Kynurenine is imported into the cell through expression of the aroP, tnaB or mtr transporter. Kynureninase is expressed to metabolize Kynurenine to Anthranilic acid in the cell. Both the transporter and kynureninase genes are optionally expressed from an inducible promoter, e.g., a FNR-inducible promoter. The bacteria may also include an auxotrophy, e.g., deletion of thyA (Δ thyA).
Figure 34:
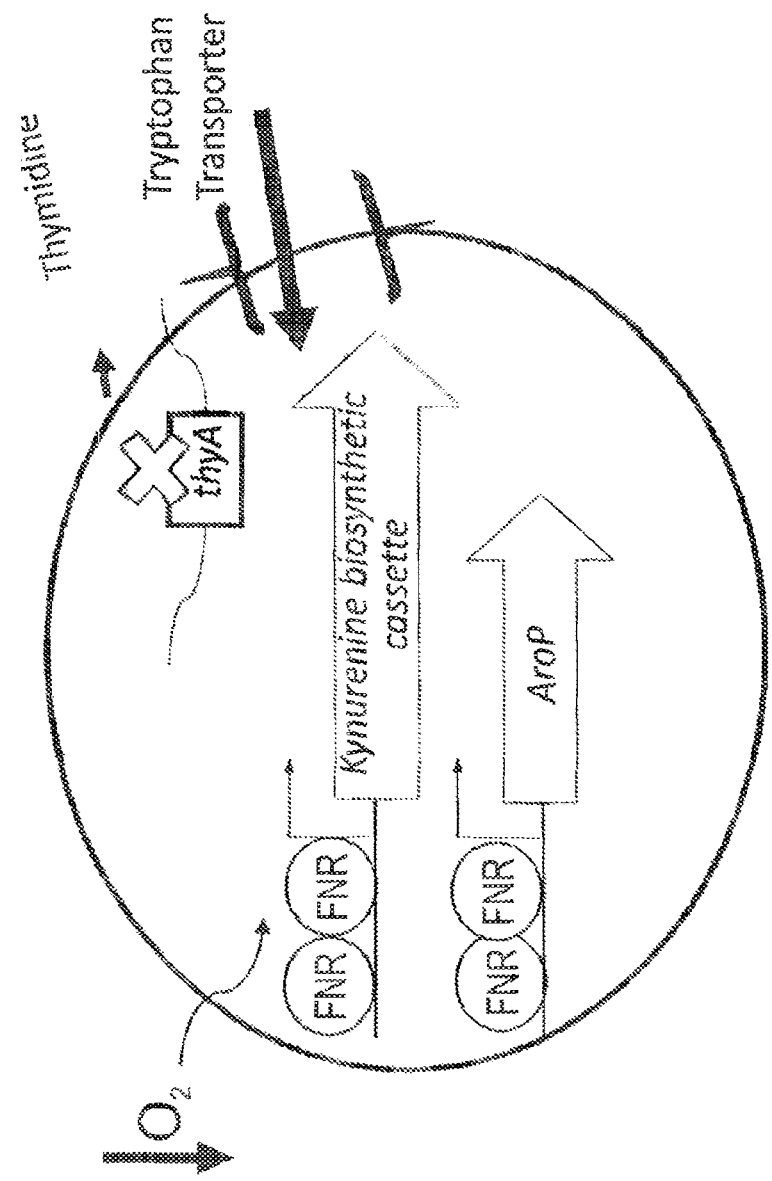
FIG. 34 depicts a schematic showing an exemplary Kynurenine Synthesis Circuit. Kynurenine and or Tryptophan is imported into the cell through expression of the aroP, tnaB or mtr transporter. Kynurenine biosynthetic cassette is expressed to produce Kynurenine. Both the transporter and Kynurenine biosynthetic cassette genes are optionally expressed from an inducible promoter, e.g., a FNR-inducible promoter. The bacteria may also include an auxotrophy, e.g., deletion of thyA (Δ thyA).
Figure 35:
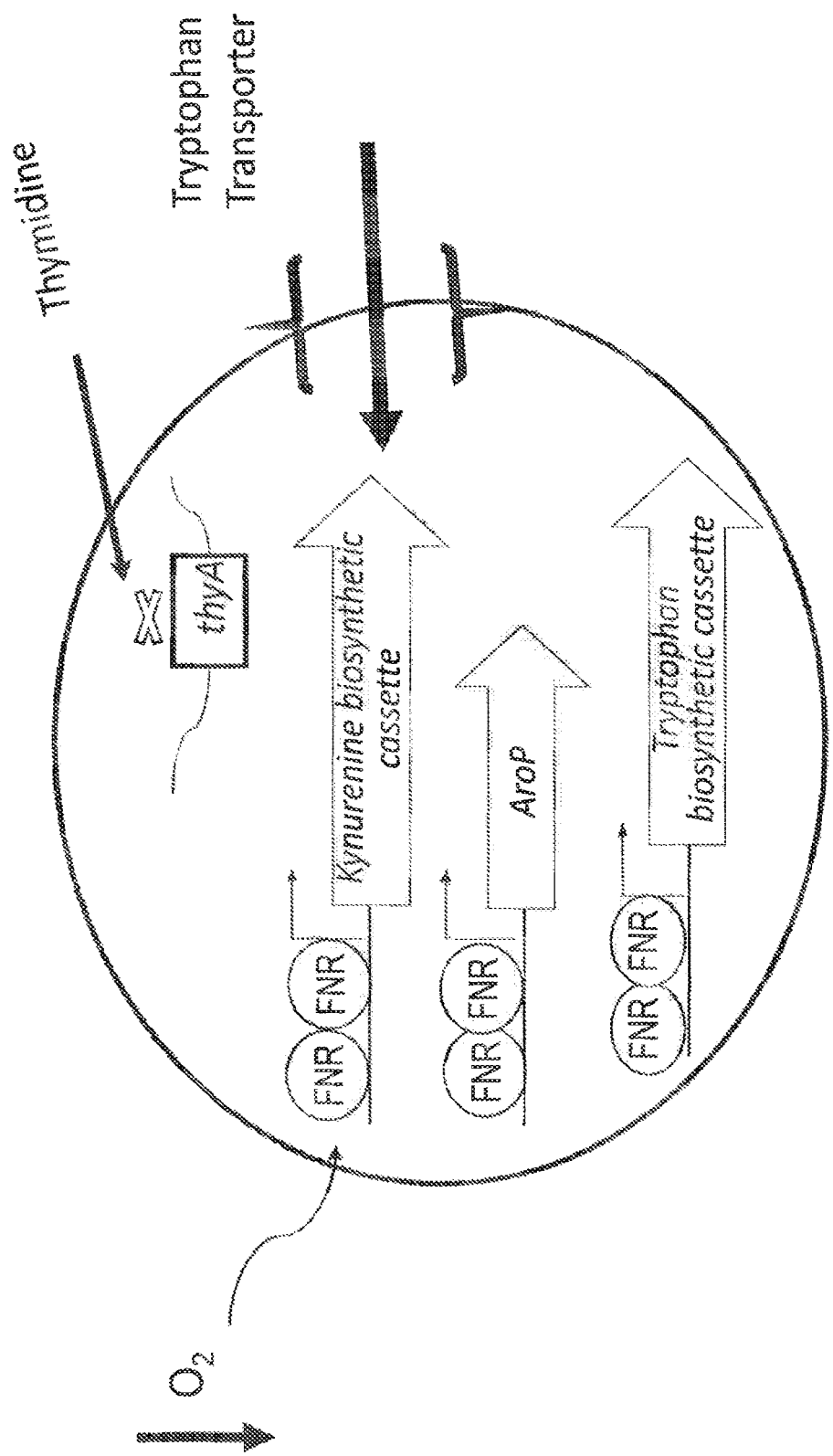
FIG. 35 depicts a schematic showing an exemplary Kynurenine Synthesis Circuit. Kynurenine and or Tryptophan is imported into the cell through expression of the aroP, tnaB or mtr transporter. Tryptophan is synthesized and then Kynurenine is synthesized from the synthesized tryptophan or from tryptophan imported into the cell. Both the transporter and kynureninase biosynthetic genes are optionally expressed from an inducible promoter, e.g., a FNR-inducible promoter. The bacteria may also include an auxotrophy, e.g., deletion of thyA (Δ thyA).
Figure 36B:
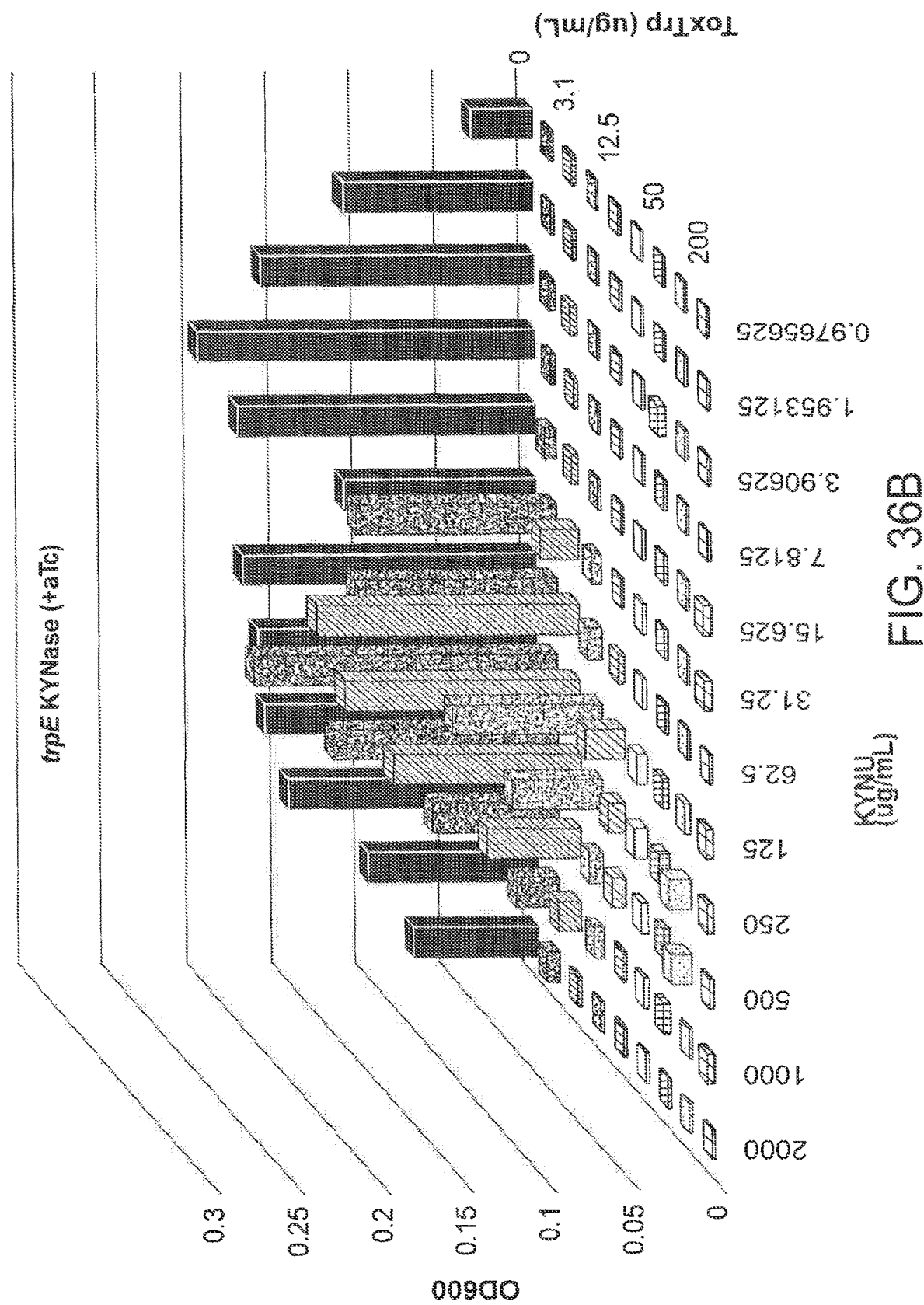
In FIG. 36B, Bacteria were grown in the presence of different concentrations of KYNU and ToxTrp, and in the presence of Anhydrous Tetracycline (aTc). Growth was assessed at OD600.
Figure 36C:
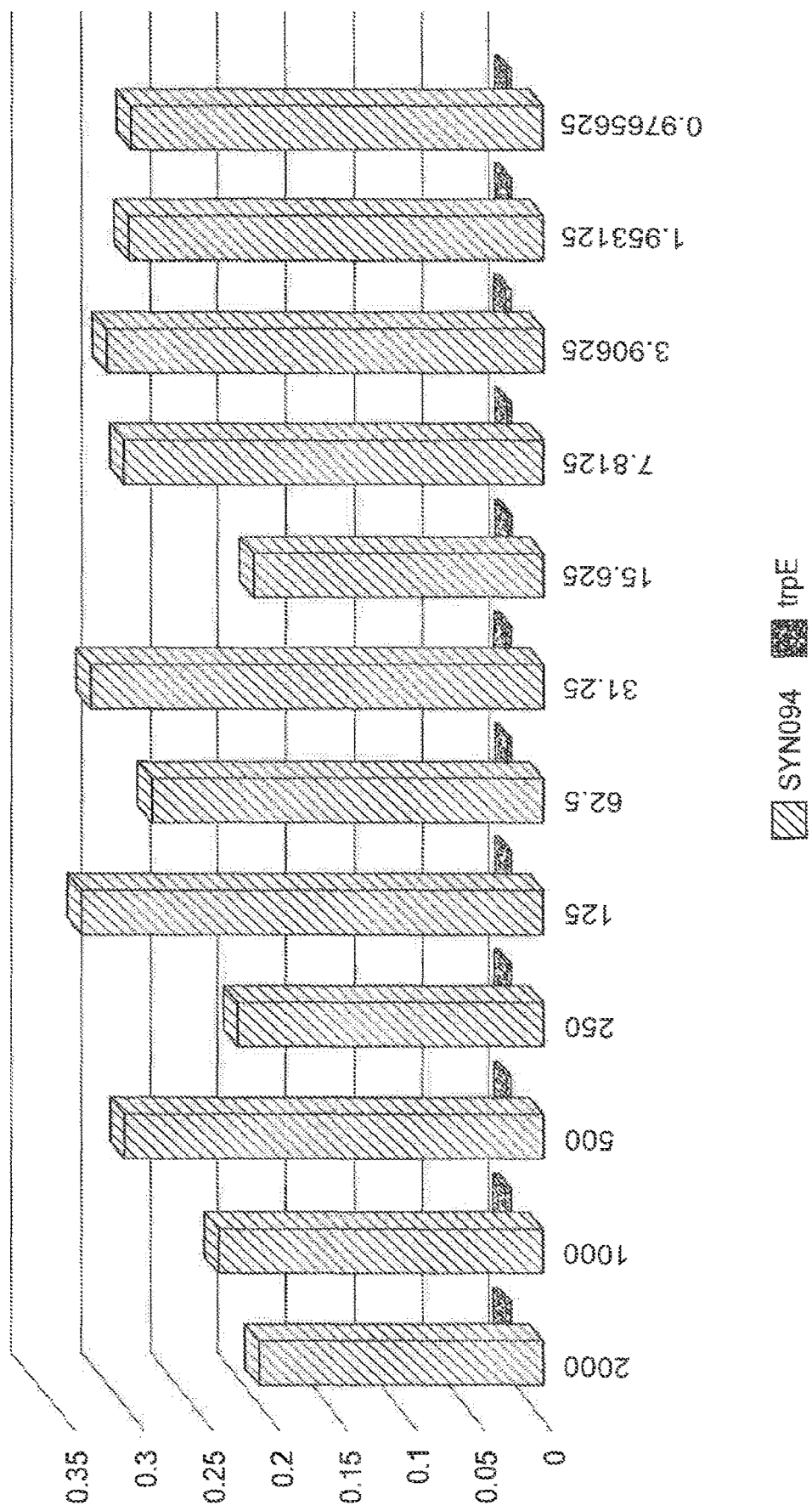
FIG. 36C depicts a bar graph showing the growth of the wild-type *E. coli* Nissle (SYN094) and trpE control strain in M9+KYNU, without ToxTrp.
Figure 37A:
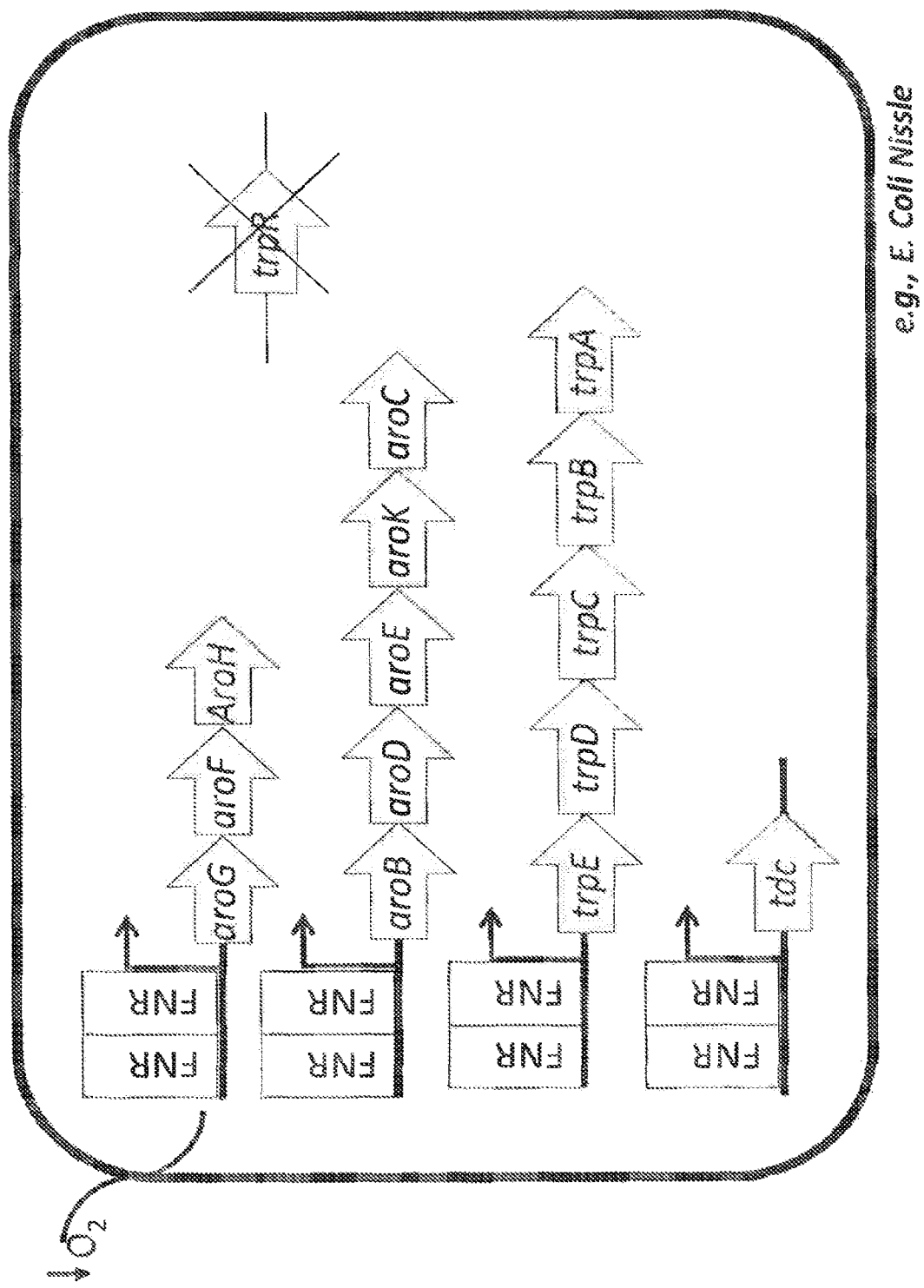
FIG. 37A depicts one embodiment of the disclosure, in which the genetically engineered bacteria produce tryptamine from tryptophan. The circuits for tryptophan production are as depicted and described in FIG. 27. Alternatively, tryptophan can be imported through a transporter. In addition, the genetically engineered bacteria comprise a circuit for Tryptophan decarboxylase, e.g., from *Catharanthus roseus*, which converts tryptophan to tryptamine, under the control of an inducible promoter e.g., an FNR promoter.
Figure 37B:
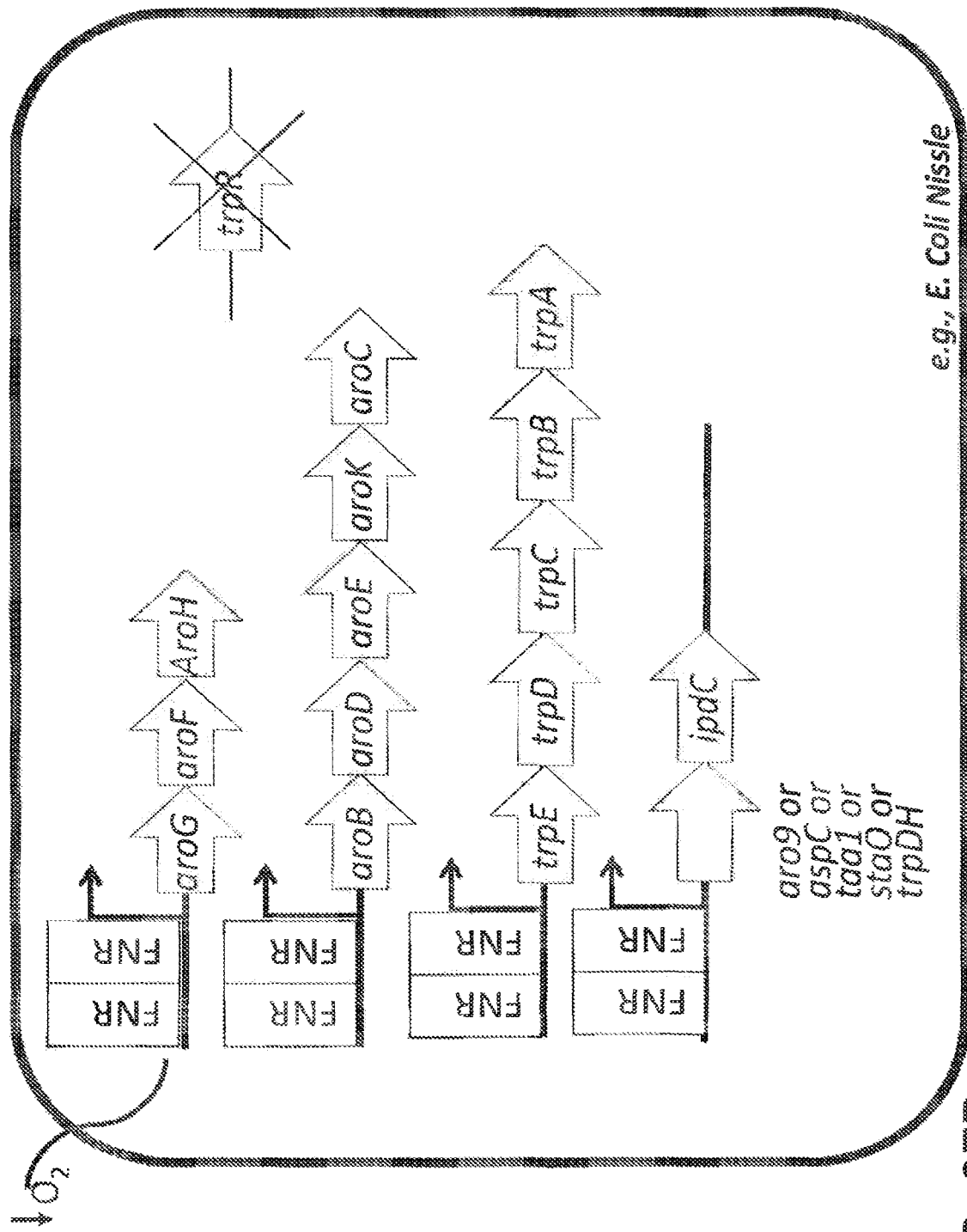
FIG. 37B depicts one embodiment of the disclosure, in which the genetically engineered bacteria produce indole-3-acetaldehyde and FICZ from tryptophan. The circuits for tryptophan production are as depicted and described in FIG. 27. Alternatively, tryptophan can be imported through a transporter. In addition, the genetically engineered bacteria comprise a circuit for aro9 (L-tryptophan aminotransferase, e.g., from *S. cerevisae*) or aspC (aspartate aminotransferase, e.g., from *E. coli*, or taa1 (L-tryptophan-pyruvate aminotransferase, e.g., from *Arabidopsis thaliana*) or staO (L-tryptophan oxidase, e.g., from *streptomyces* sp. TP-A0274) or trpDH (Tryptophan dehydrogenase, e.g., from *Nostoc punctiforme* NIES-2108) and ipdC (Indole-3-pyruvate decarboxylase, e.g., from *Enterobacter cloacae*) which together produce indole-3-acetaldehyde and FICZ from tryptophan, under the control of an inducible promoter e.g., an FNR promoter.
Figure 37C:
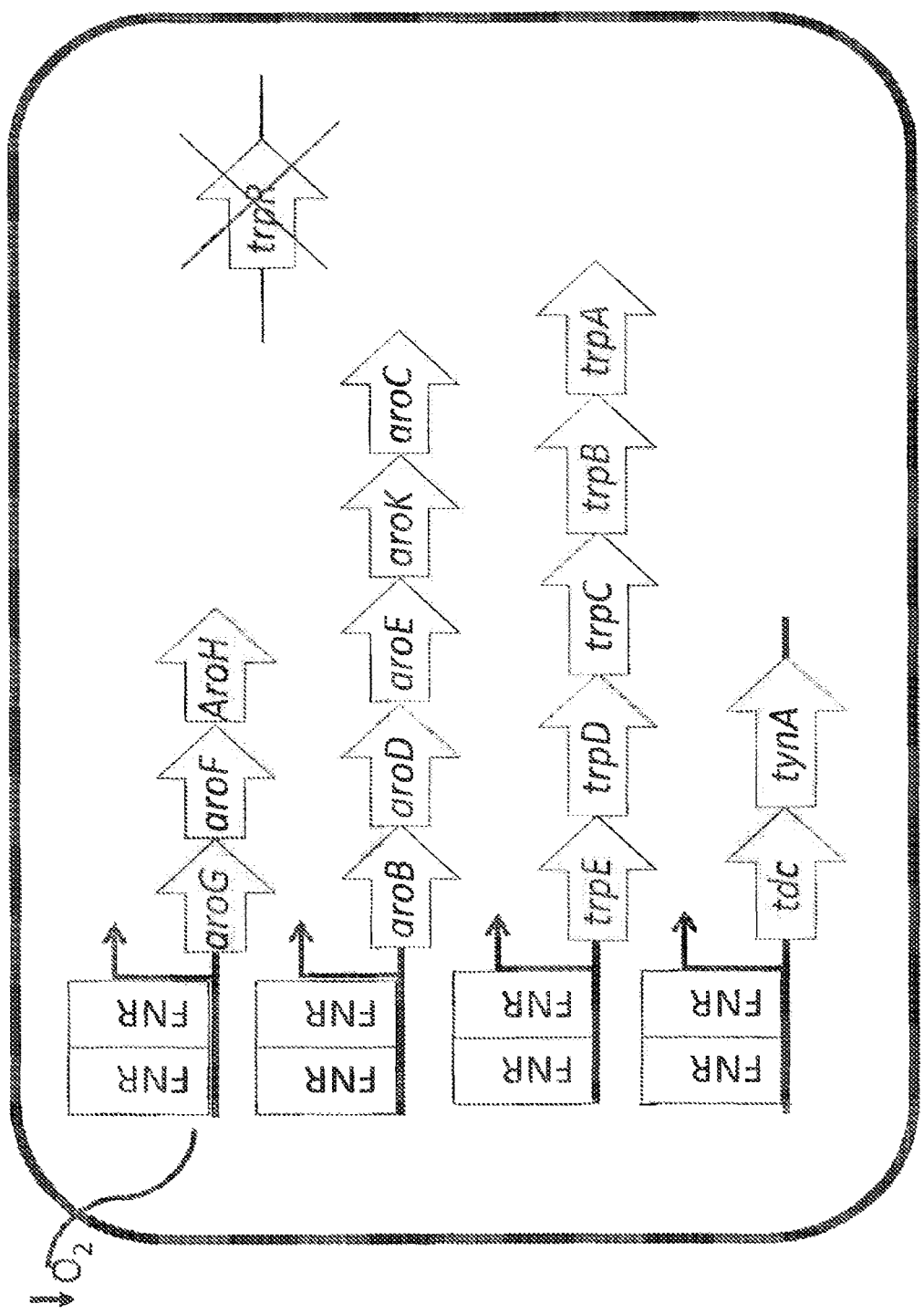
FIG. 37C depicts one embodiment of the disclosure, in which the genetically engineered bacteria produce indole-3-acetaldehyde and FICZ from tryptophan. The circuits for tryptophan production are as depicted and described in FIG. 27. Alternatively, tryptophan can be imported through a transporter. In addition, the genetically engineered bacteria comprise a circuit comprising tdc (Tryptophan decarboxylase, e.g., from *Catharanthus roseus*), and tynA (Monoamine oxidase, e.g., from *E. coli*), which converts tryptophan to indole-3-acetaldehyde and FICZ, under the control of an inducible promoter e.g., an FNR promoter.
Figure 37D:
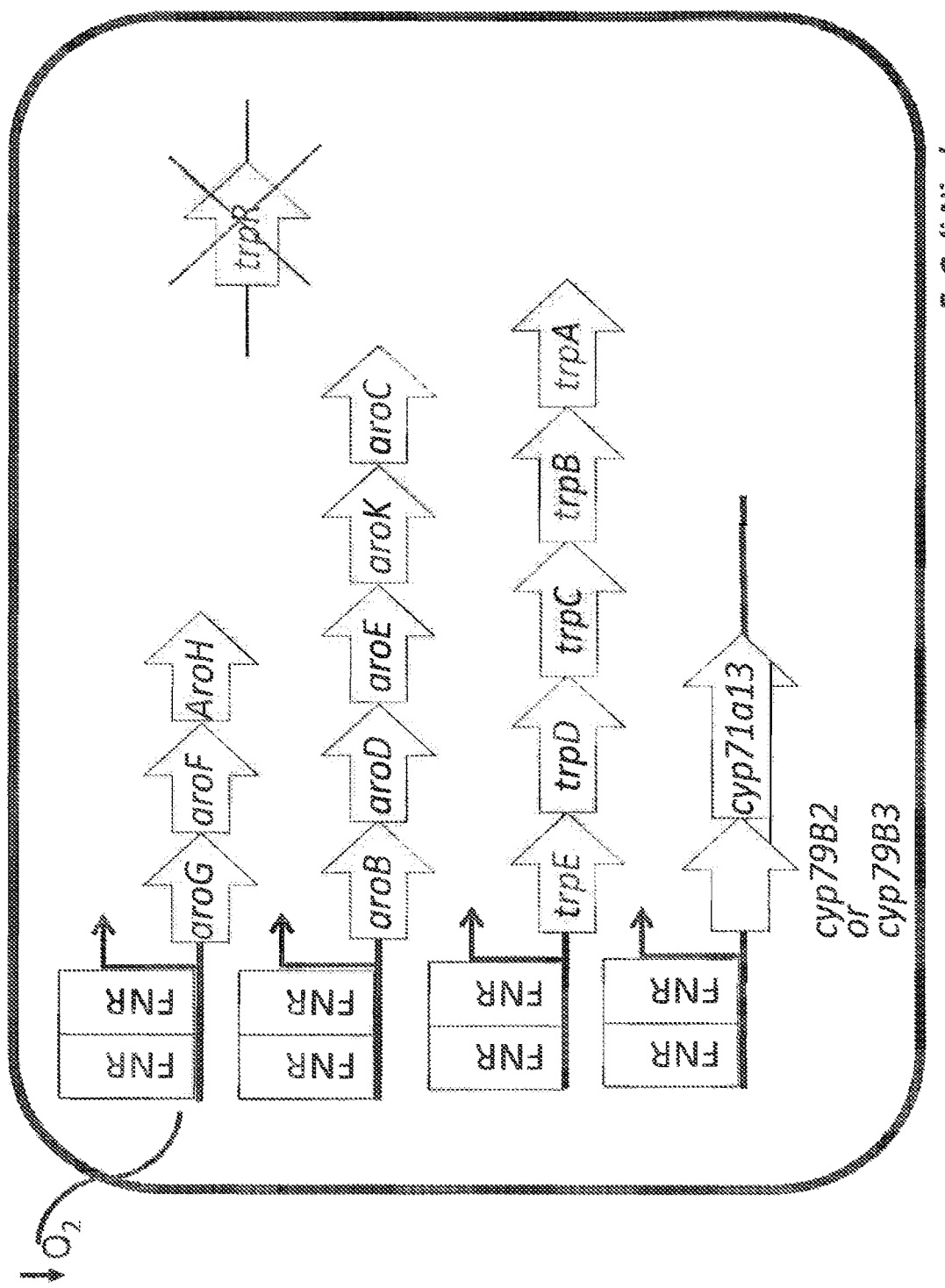
FIG. 37D depicts one embodiment of the disclosure, in which the genetically engineered bacteria produce indole-3-acetonitrile from tryptophan. The circuits for tryptophan production are as depicted and described in FIG. 27. Alternatively, tryptophan can be imported through a transporter. In addition, the genetically engineered bacteria comprise a circuit for cyp79B2 (tryptophan N-monooxygenase, e.g., from *Arabidopsis thaliana*) or cyp79B3 (tryptophan N-monooxygenase, e.g., from *Arabidopsis thaliana*), which together convert tryptophan to indole-3-acetonitrile, under the control of an inducible promoter e.g., an FNR promoter.
Figure 37E:
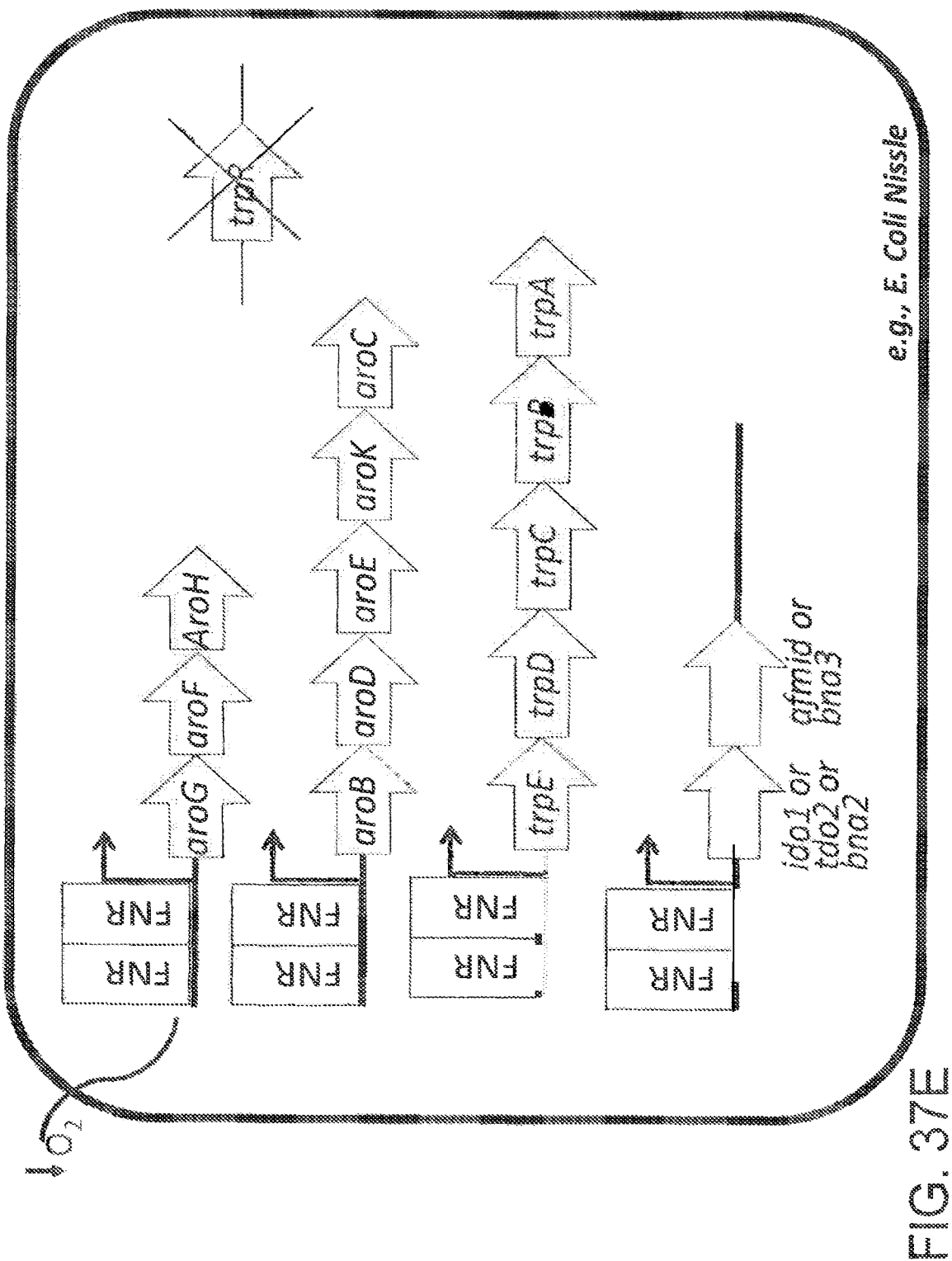
FIG. 37E depicts one embodiment of the disclosure, in which the genetically engineered bacteria produce kynurenine from tryptophan. The circuits for tryptophan production are as depicted and described in FIG. 27. Alternatively, tryptophan can be imported through a transporter. In addition, the genetically engineered bacteria comprise a circuit comprising IDO1 (indoleamine 2,3-dioxygenase, e.g., from *Homo sapiens* or TDO2 (tryptophan 2,3-dioxygenase, e.g., from *Homo sapiens*) or BNA2 (indoleamine 2,3-dioxygenase, e.g., from *S. cerevisiae*) and Afmid: Kynurenine formamidase, e.g., from mouse) or BNA3 (kynurenine-oxoglutarate transaminase, e.g., from *S. cerevisae*) which together convert tryptophan to kynurenine, under the control of an inducible promoter e.g., an FNR promoter.
Figure 37F:
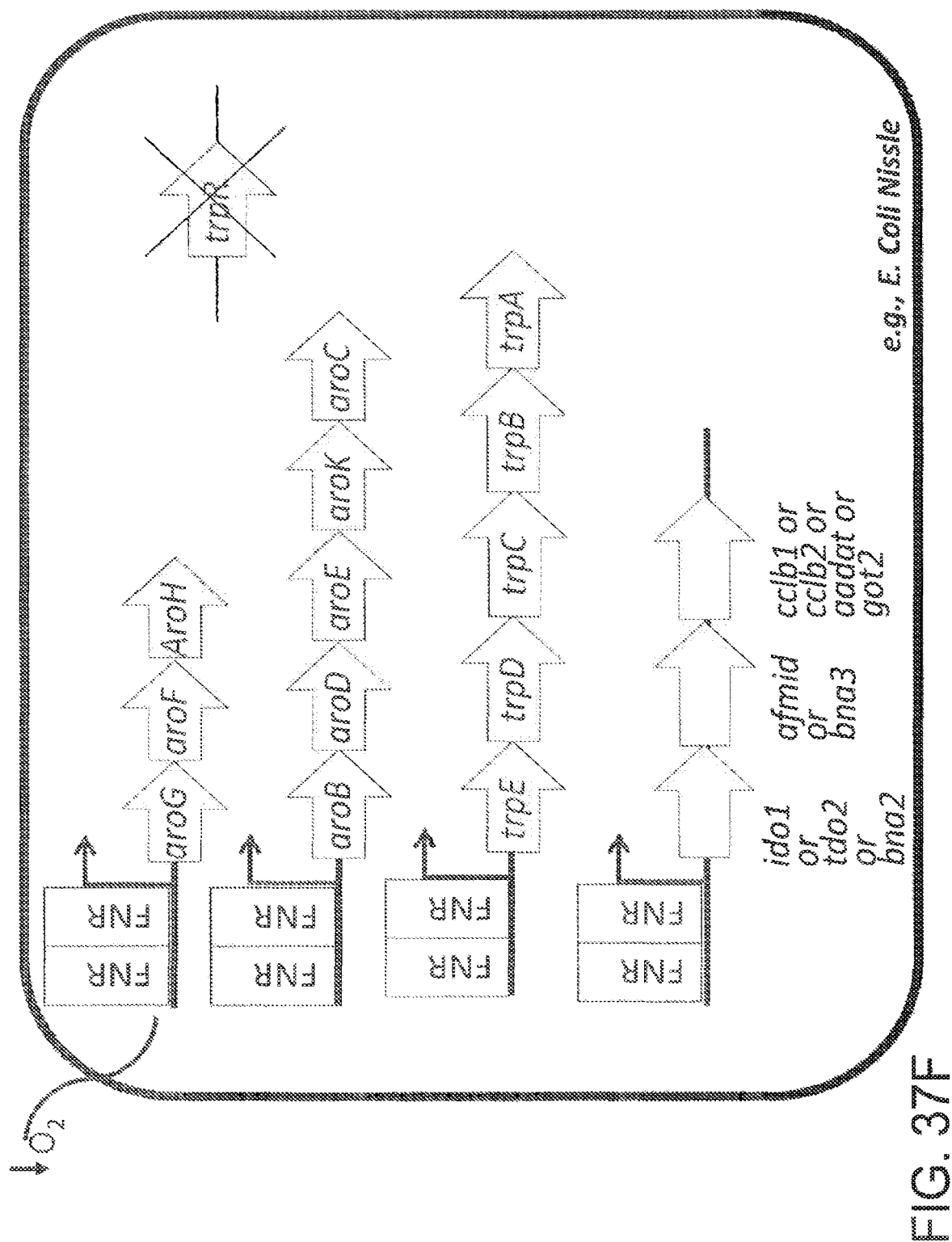
FIG. 37F depicts one embodiment of the disclosure, in which the genetically engineered bacteria produce kynureninic acid from tryptophan. The circuits for tryptophan production are as depicted and described in FIG. 27. Alternatively, tryptophan can be imported through a transporter. In addition, the genetically engineered bacteria comprise a circuit comprising IDO1 (indoleamine 2,3-dioxygenase, e.g., from *Homo sapiens* or TDO2 (tryptophan 2,3-dioxygenase, e.g., from *Homo sapiens*) or BNA2 (indoleamine 2,3-dioxygenase, e.g., from *S. cerevisiae*) and Afmid: Kynurenine formamidase, e.g., from mouse) or BNA3 (kynurenine-oxoglutarate transaminase, e.g., from *S. cerevisae*) and GOT2 (Aspartate aminotransferase, mitochondrial, e.g., from *Homo sapiens* or AADAT (Kynurenine/alpha-aminoadipate aminotransferase, mitochondrial, e.g., from *Homo sapiens*), or CCLB1 (Kynurenine-oxoglutarate transaminase 1, e.g., from *Homo sapiens*) or CCLB2 (kynurenine-oxoglutarate transaminase 3, e.g., from *Homo sapiens*, which together produce kynureninic acid from tryptophan, under the control of an inducible promoter, e.g., an FNR promoter.
Figure 37G:
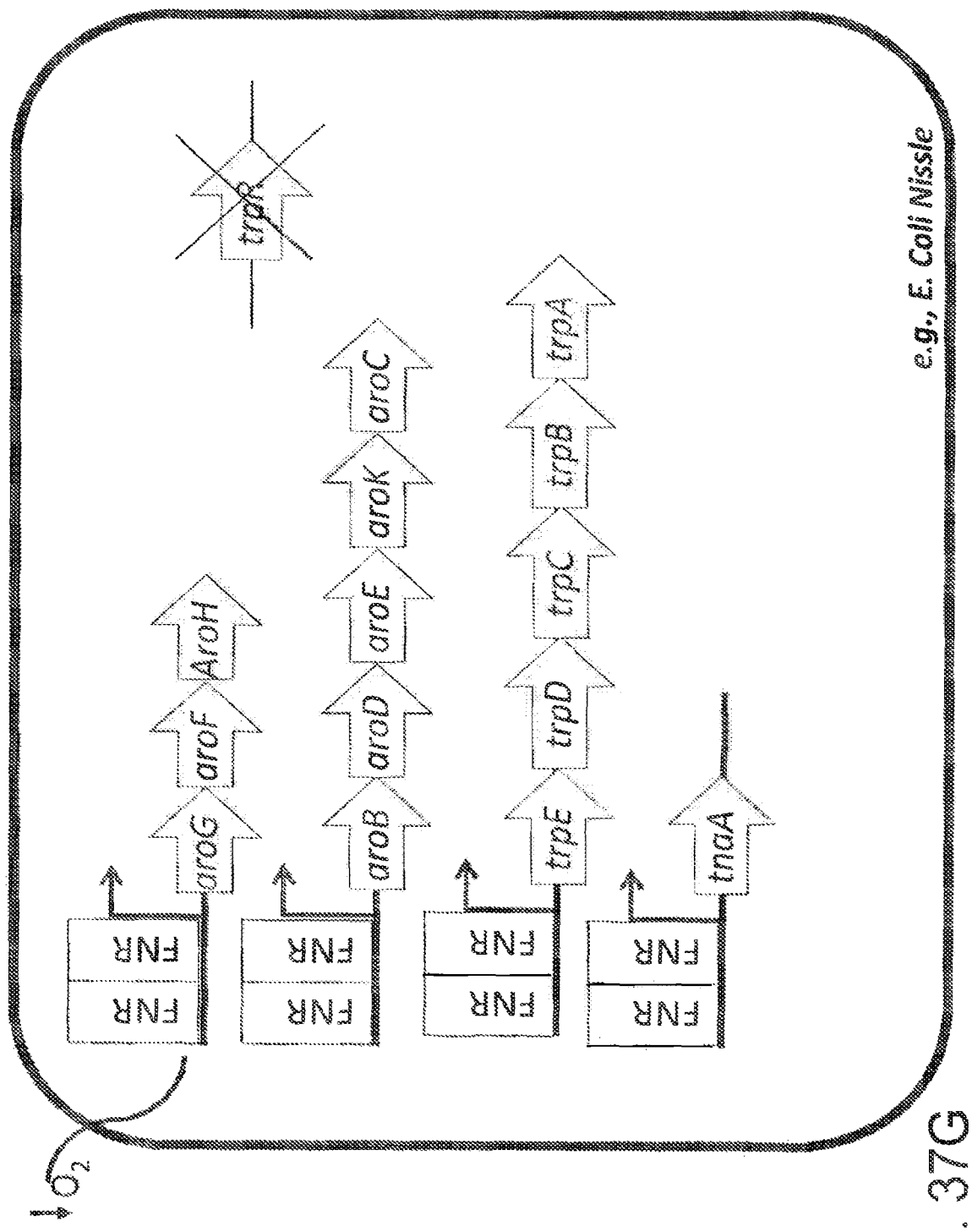
FIG. 37G depicts one embodiment of the disclosure, in which the genetically engineered bacteria produce indole from tryptophan. The circuits for tryptophan production are as depicted and described in FIG. 27. Alternatively, tryptophan can be imported through a transporter. In addition, the genetically engineered bacteria comprise a circuit for tnaA (tryptophanase, e.g., from *E. coli*), which converts tryptophan to indole, under the control of an inducible promoter e.g., an FNR promoter.
Figure 37H:
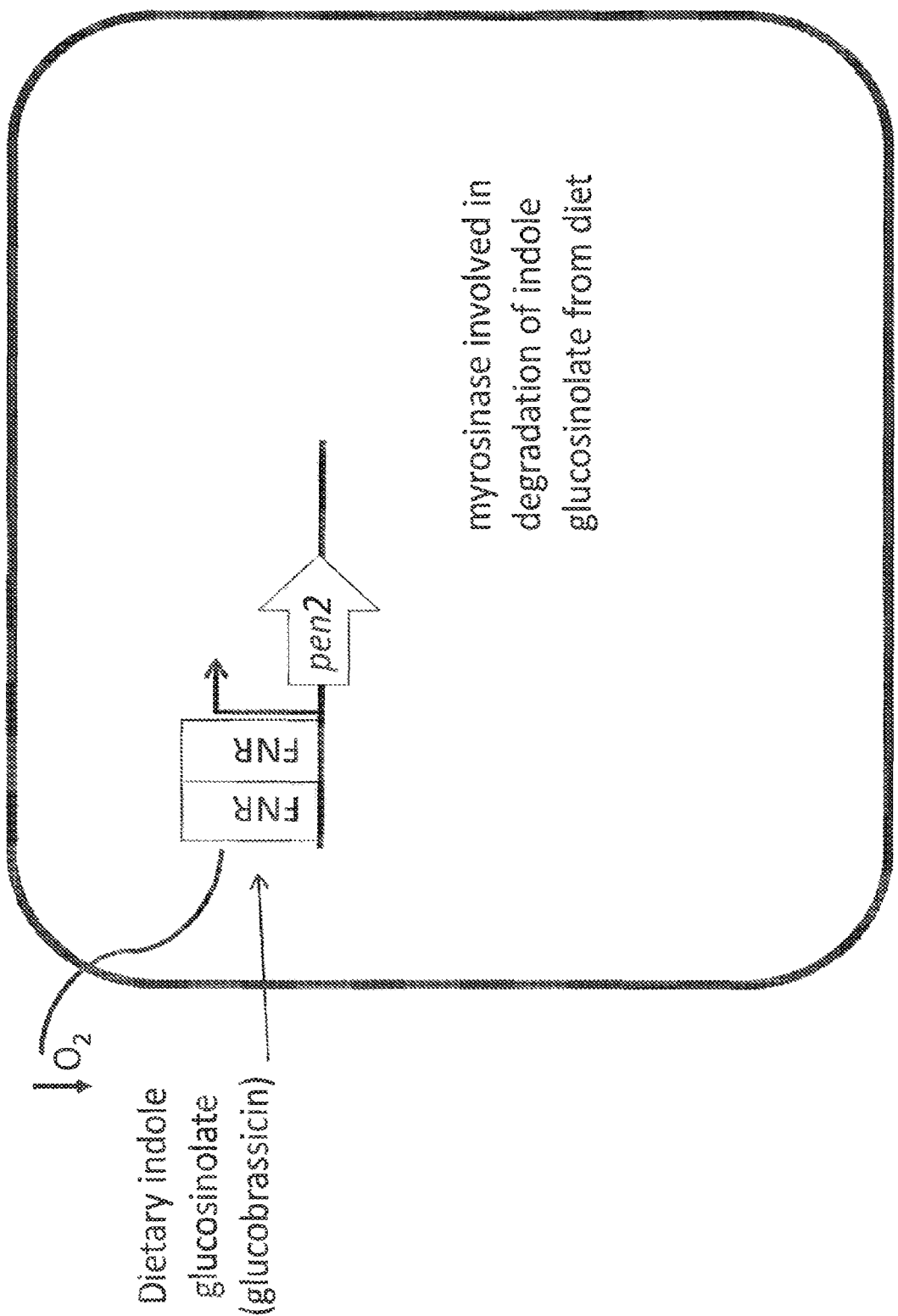
FIG. 37H depicts one embodiment of the disclosure, in which the genetically engineered bacteria produce indole-3-carbinol, indole-3-aldehyde, 3,3' diindolylmethane (DIM), indolo(3,2-b) carbazole (ICZ) from indole glucosinolate taken up through the diet. The genetically engineered bacteria comprise a circuit comprising pne2 (myrosinase, e.g., from *Arabidopsis thaliana*) under the control of an inducible promoter, e.g. an FNR promoter.
Figure 38A:
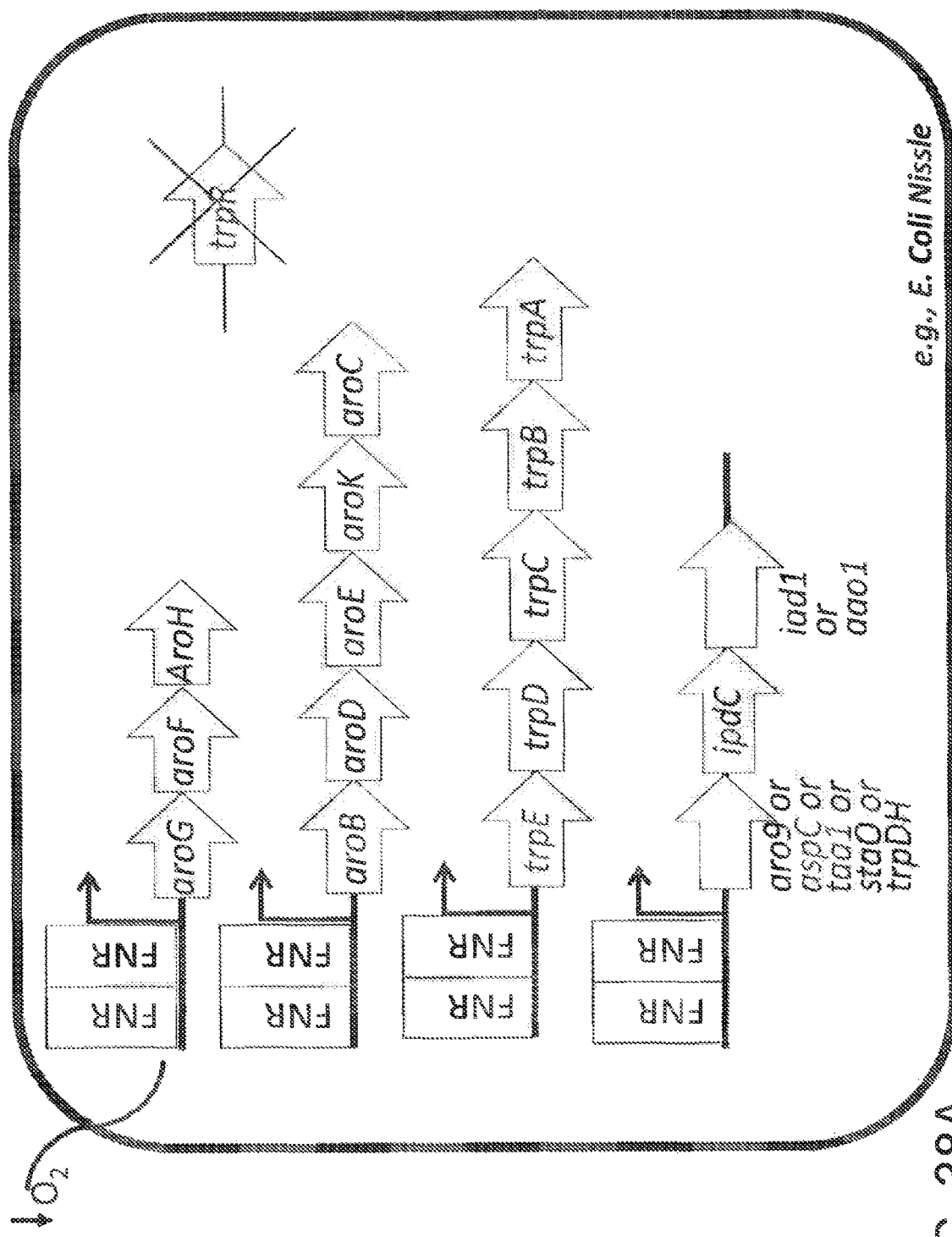
In FIG. 38A, the circuits for tryptophan production are as depicted and described in FIG. 27. Alternatively, tryptophan can be imported through a transporter. In addition, the genetically engineered bacteria comprise a circuit comprising aro9 (L-tryptophan aminotransferase, e.g., from *S. cerevisae*) or aspC (aspartate aminotransferase, e.g., from *E. coli*, or taa1 (L-tryptophan-pyruvate aminotransferase, e.g., from *Arabidopsis thaliana*) or staO (L-tryptophan oxidase, e.g., from *streptomyces* sp. TP-A0274) or trpDH (Tryptophan dehydrogenase, e.g., from *Nostoc punctiforme* NIES-2108) and ipdC (Indole-3-pyruvate decarboxylase, e.g., from *Enterobacter cloacae*) and iad1 (Indole-3-acetaldehyde dehydrogenase, e.g., from *Ustilago maydis*) or AAO1 (Indole-3-acetaldehyde oxidase, e.g., from *Arabidopsis thaliana*) which together produce indole-3-acetic acid from tryptophan, under the control of an inducible promoter e.g., an FNR promoter.
Figure 38B:
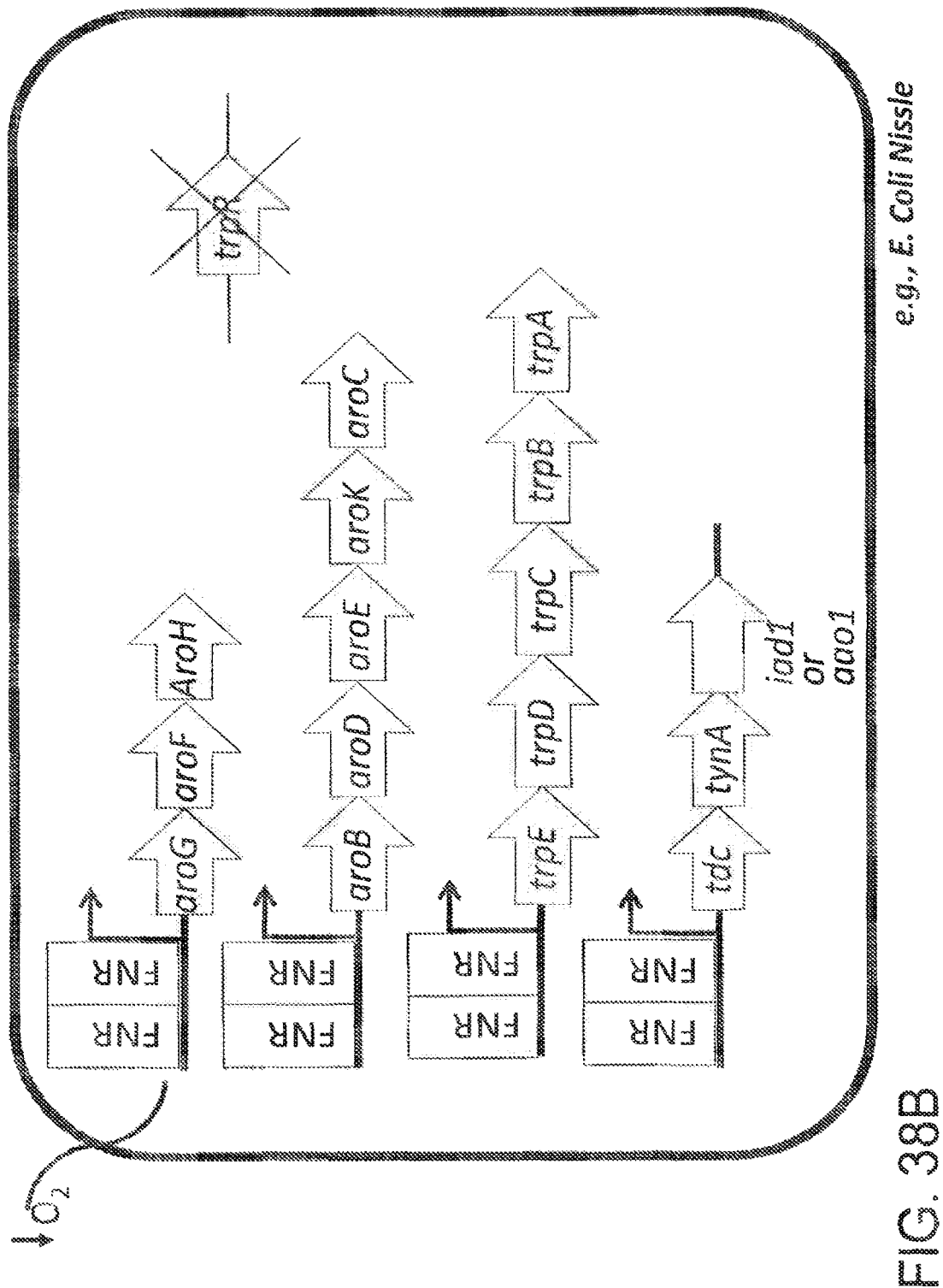
In FIG. 38B the circuits for tryptophan production are as depicted and described in FIG. 27. Alternatively, tryptophan can be imported through a transporter. In addition, the genetically engineered bacteria comprise a circuit comprising tdc (Tryptophan decarboxylase, e.g., from *Catharanthus roseus*) ot tynA (Monoamine oxidase, e.g., from *E. coli*) and or iad1 (Indole-3-acetaldehyde dehydrogenase, e.g., from *Ustilago maydis*) or AAO1 (Indole-3-acetaldehyde oxidase, e.g., from *Arabidopsis thaliana*), under the control of an inducible promoter e.g., an FNR promoter.
Figure 38C:
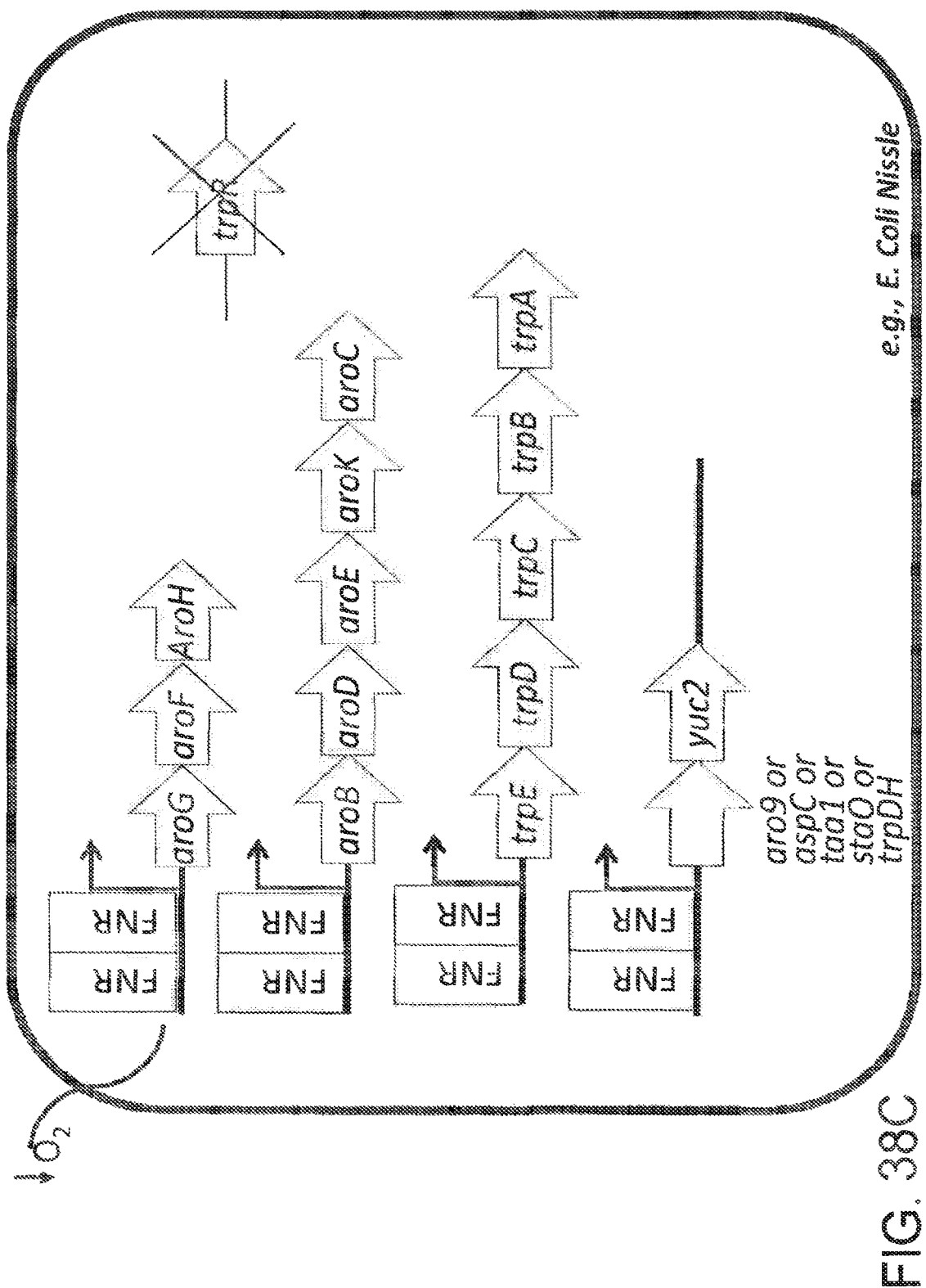
In FIG. 38C the circuits for tryptophan production are as depicted and described in FIG. 27. Alternatively, tryptophan can be imported through a transporter. In addition, the genetically engineered bacteria comprise a circuit comprising aro9 (L-tryptophan aminotransferase, e.g., from *S. cerevisae*) or aspC (aspartate aminotransferase, e.g., from *E. coli*, or taa1 (L-tryptophan-pyruvate aminotransferase, e.g., from *Arabidopsis thaliana*) or staO (L-tryptophan oxidase, e.g., from *streptomyces* sp. TP-A0274) or trpDH (Tryptophan dehydrogenase, e.g., from *Nostoc punctiforme* NIES-2108) and yuc2 (indole-3-pyruvate monoxygenase, e.g., from *Arabidopsis thaliana*) under the control of an inducible promoter e.g., an FNR promoter.
Figure 38D:
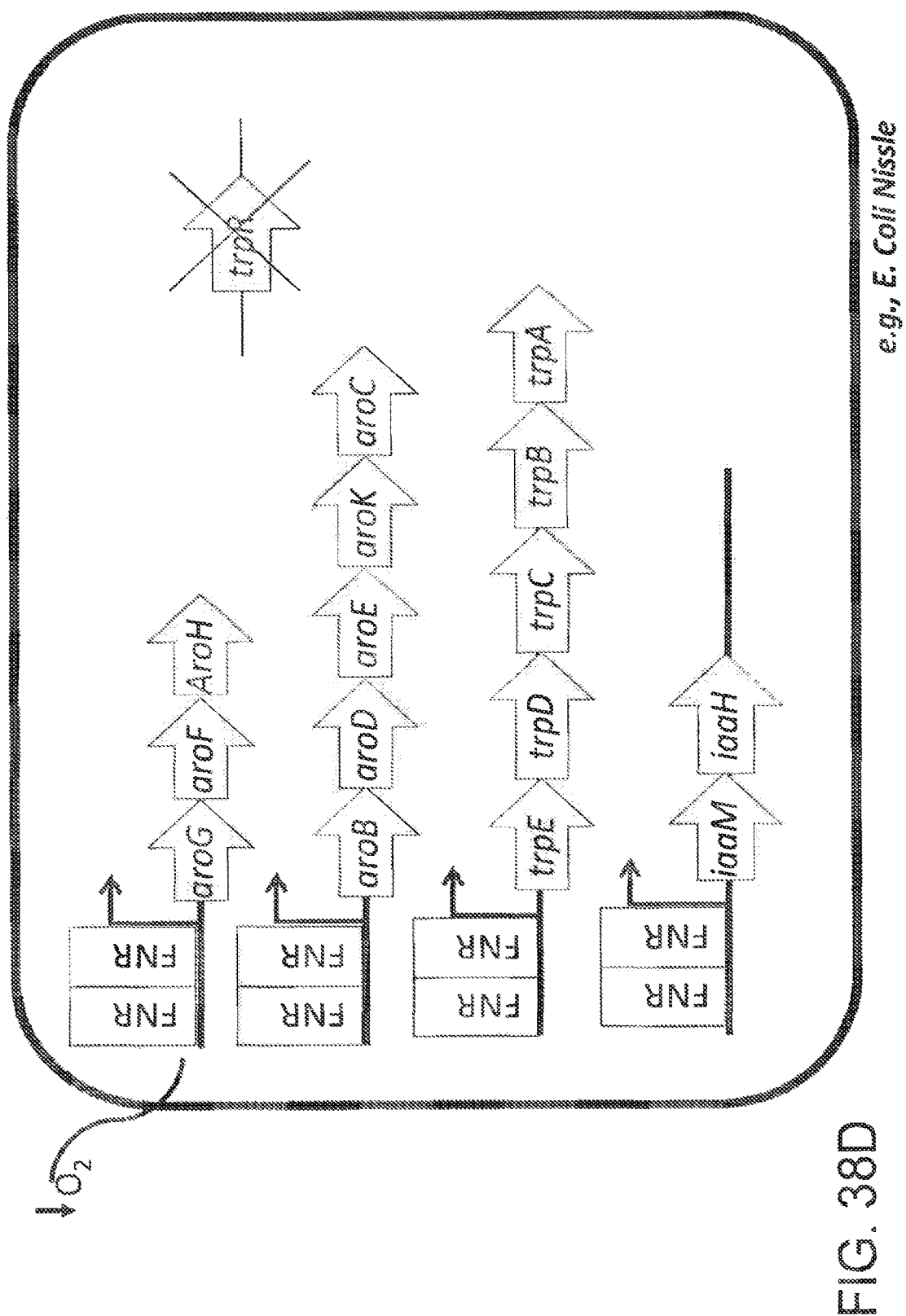
In FIG. 38D the circuits for tryptophan production are as depicted and described in FIG. 27. Alternatively, tryptophan can be imported through a transporter. In addition, the genetically engineered bacteria comprise a circuit comprising IaaM (Tryptophan 2-monooxygenase e.g., from *Pseudomonas savastanoi*) and iaaH (Indoleacetamide hydrolase, e.g., from *Pseudomonas savastanoi*), under the control of an inducible promoter e.g., an FNR promoter.
Figure 38E:
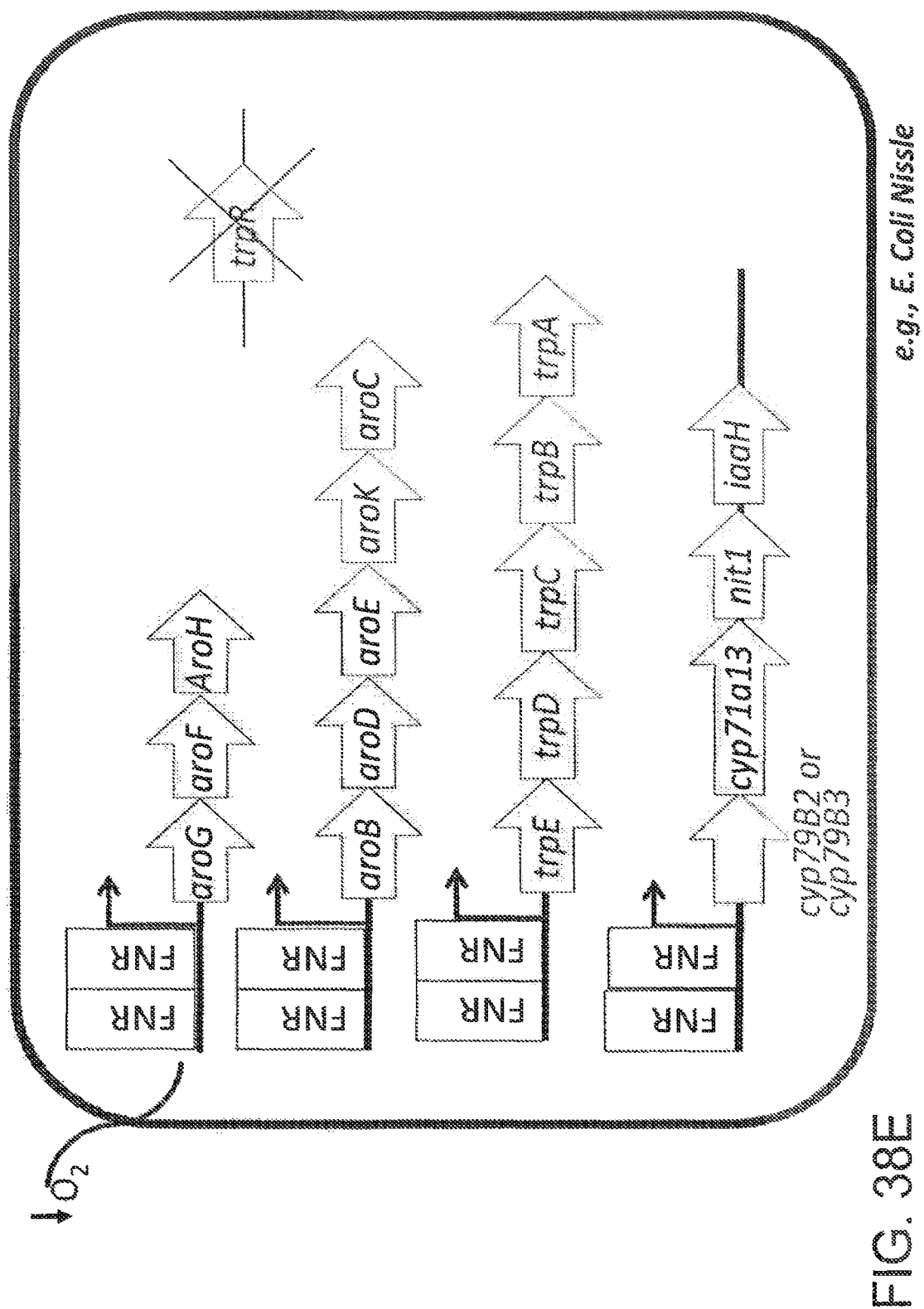
FIG. 38 depicts schematics of exemplary embodiment of the disclosure, in which the genetically engineered bacteria convert tryptophan into indole-3-acetic acid.
Figure 39:
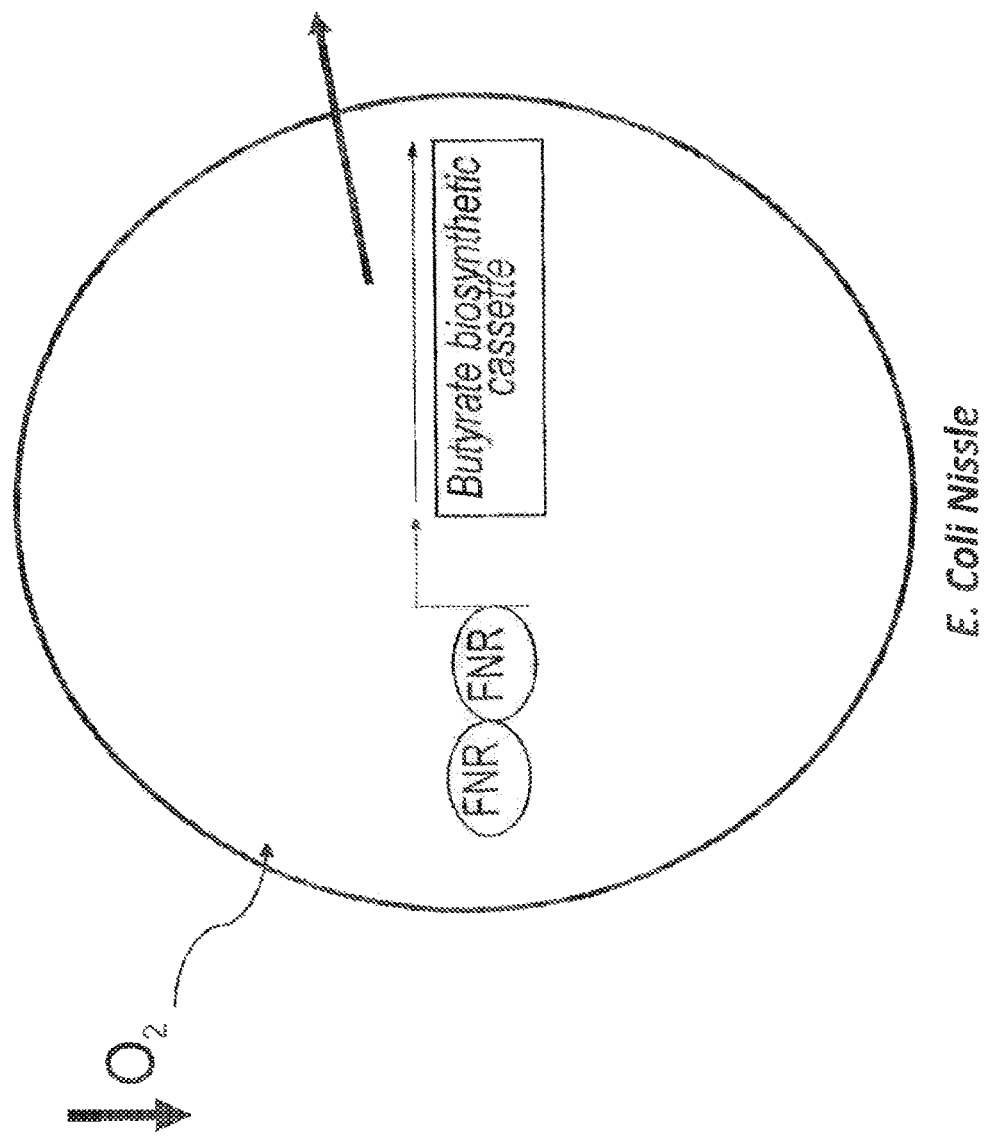
FIG. 39 depicts a schematic of an *E. coli* that is genetically engineered to express a butyrate cassette.
Figure 40:
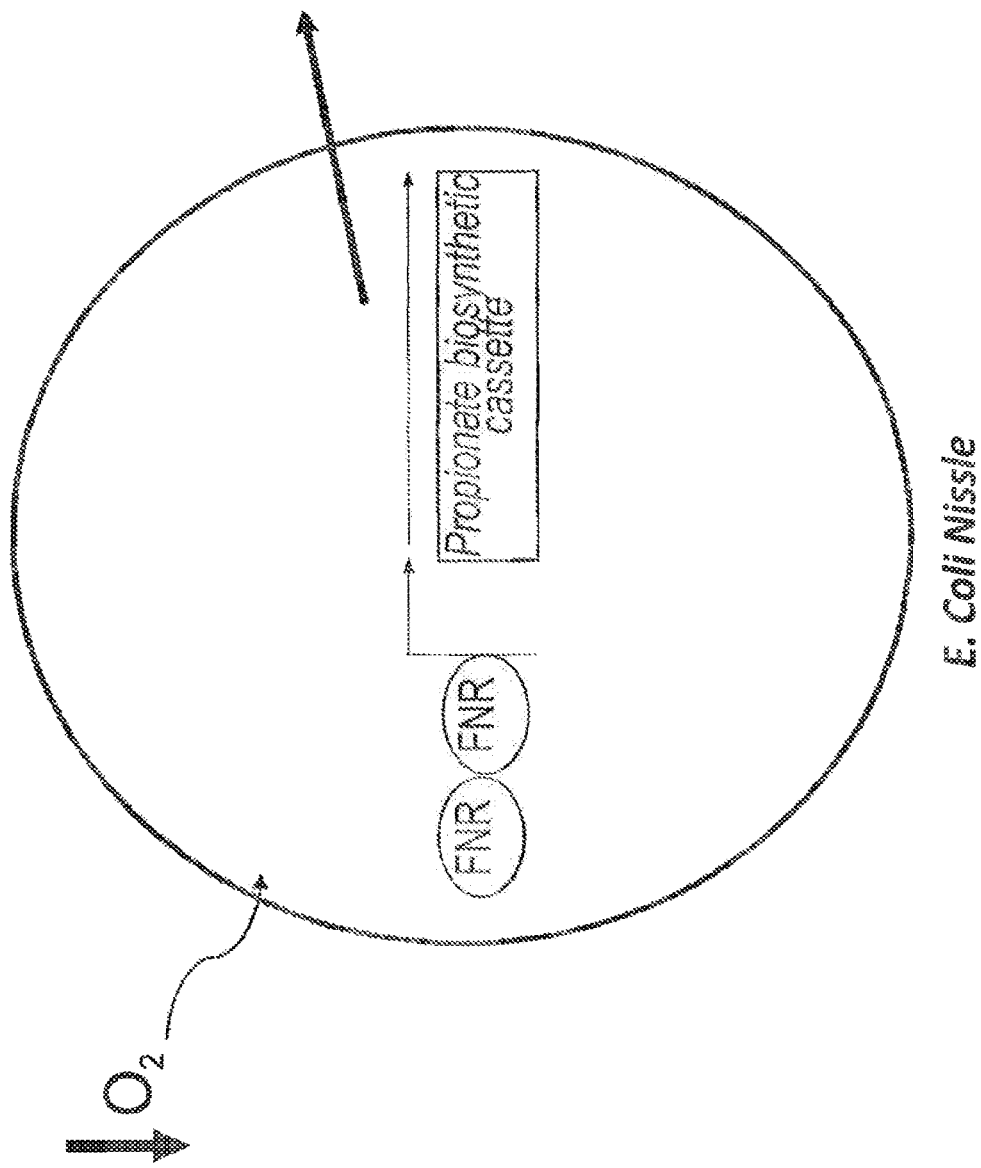
FIG. 40 depicts a schematic of an *E. coli* that is genetically engineered to express a propionate biosynthestic cassette.
Figure 41:
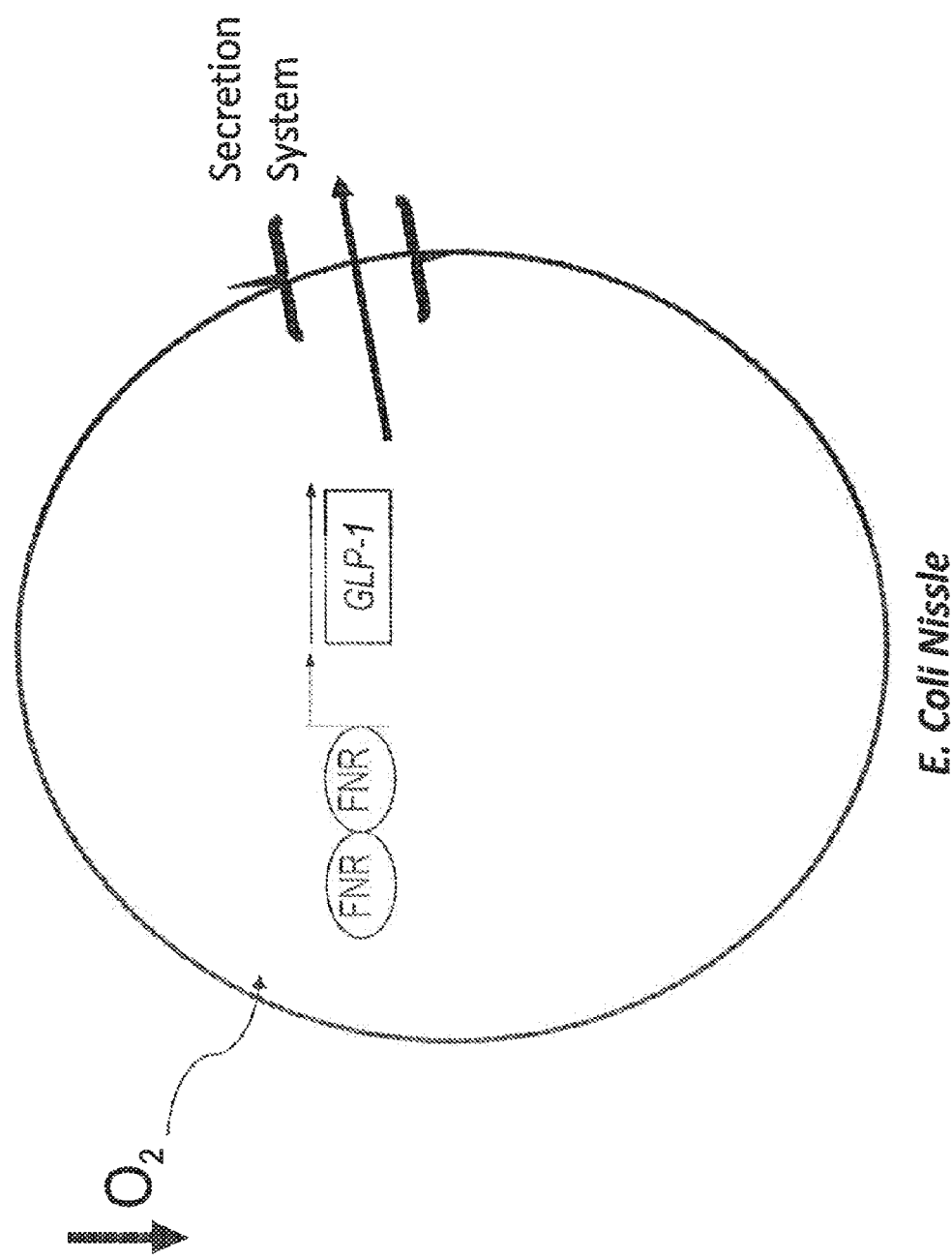
FIG. 41 depicts a schematic of an *E. coli* that is genetically engineered to express a GLP-1 and a secretion system as known in the art or described herein.
Figure 42:
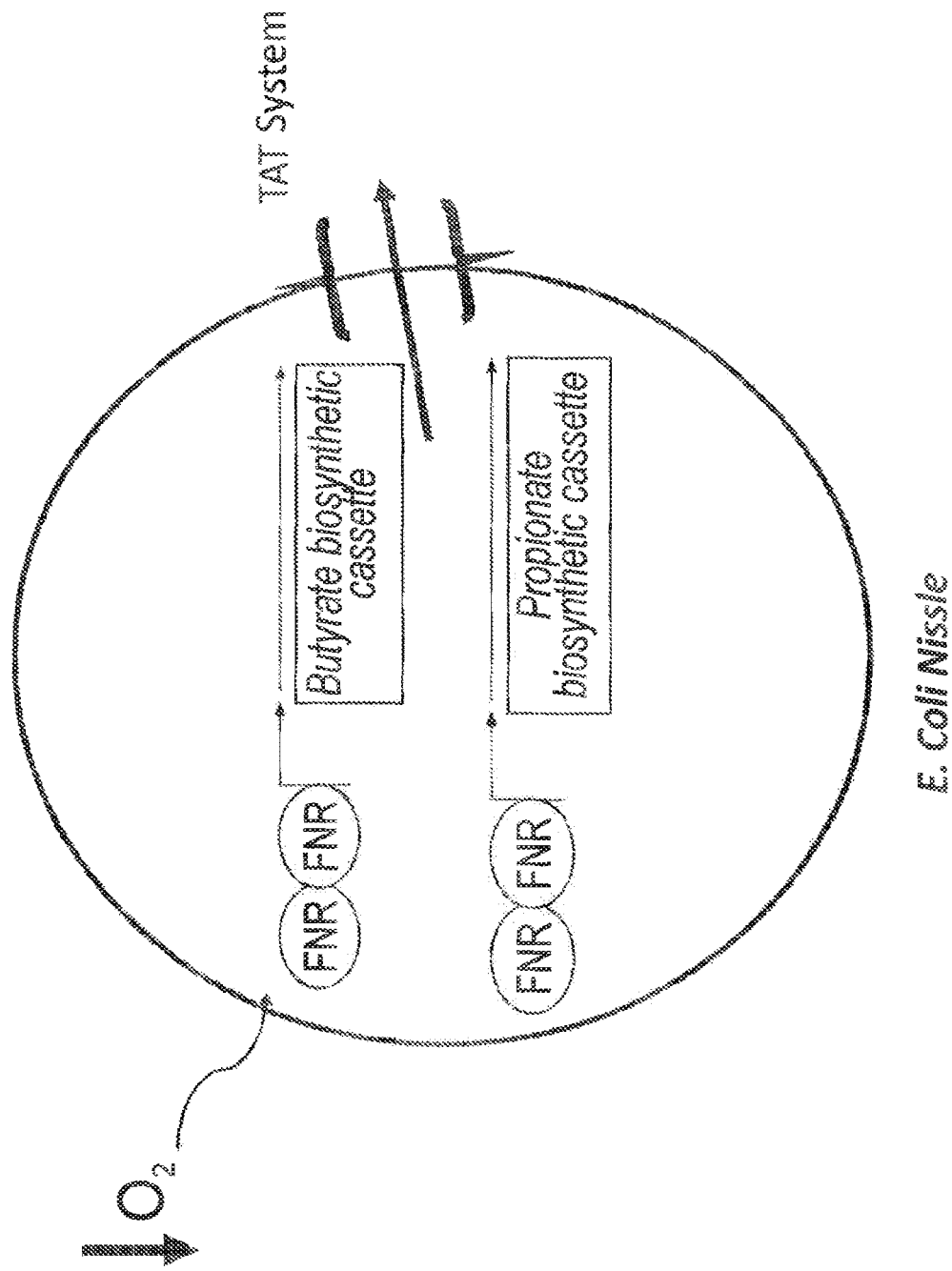
FIG. 42 depicts a schematic of an *E. coli* that is genetically engineered to express a butyrate and a propionate biosynthestic cassette.
Figure 43:
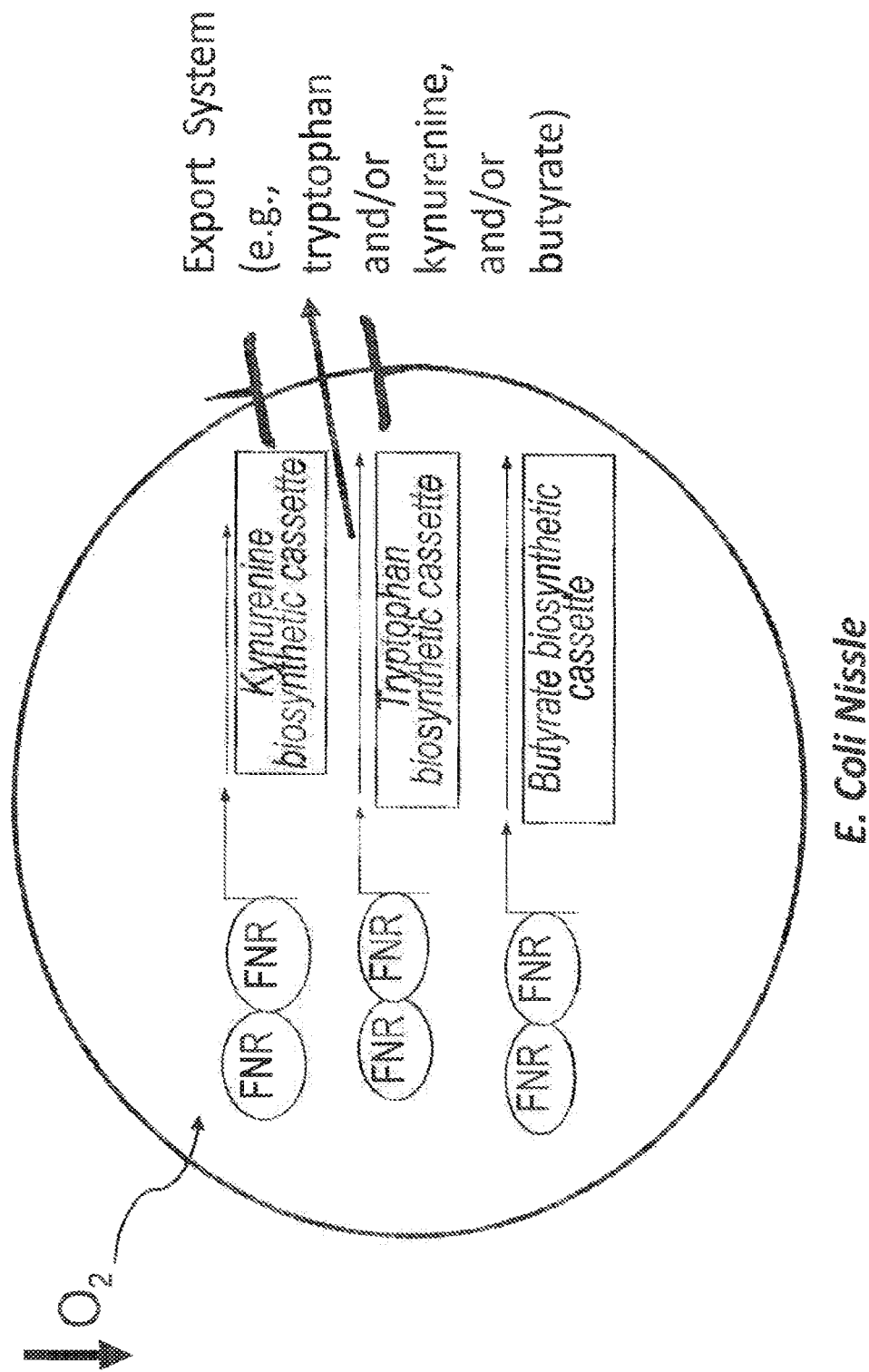
FIG. 43 depicts a schematic of an *E. coli* that is genetically engineered to produce kynurenine, butyrate, and tryptophan (which can be converted to kynurenine or exported), under the control of a FNR-responsive promoter and further comprising a secretion system as known in the art or described herein. Export mechanism for kynurenine and/or tryptophan is also expressed or provided.
Figure 44:
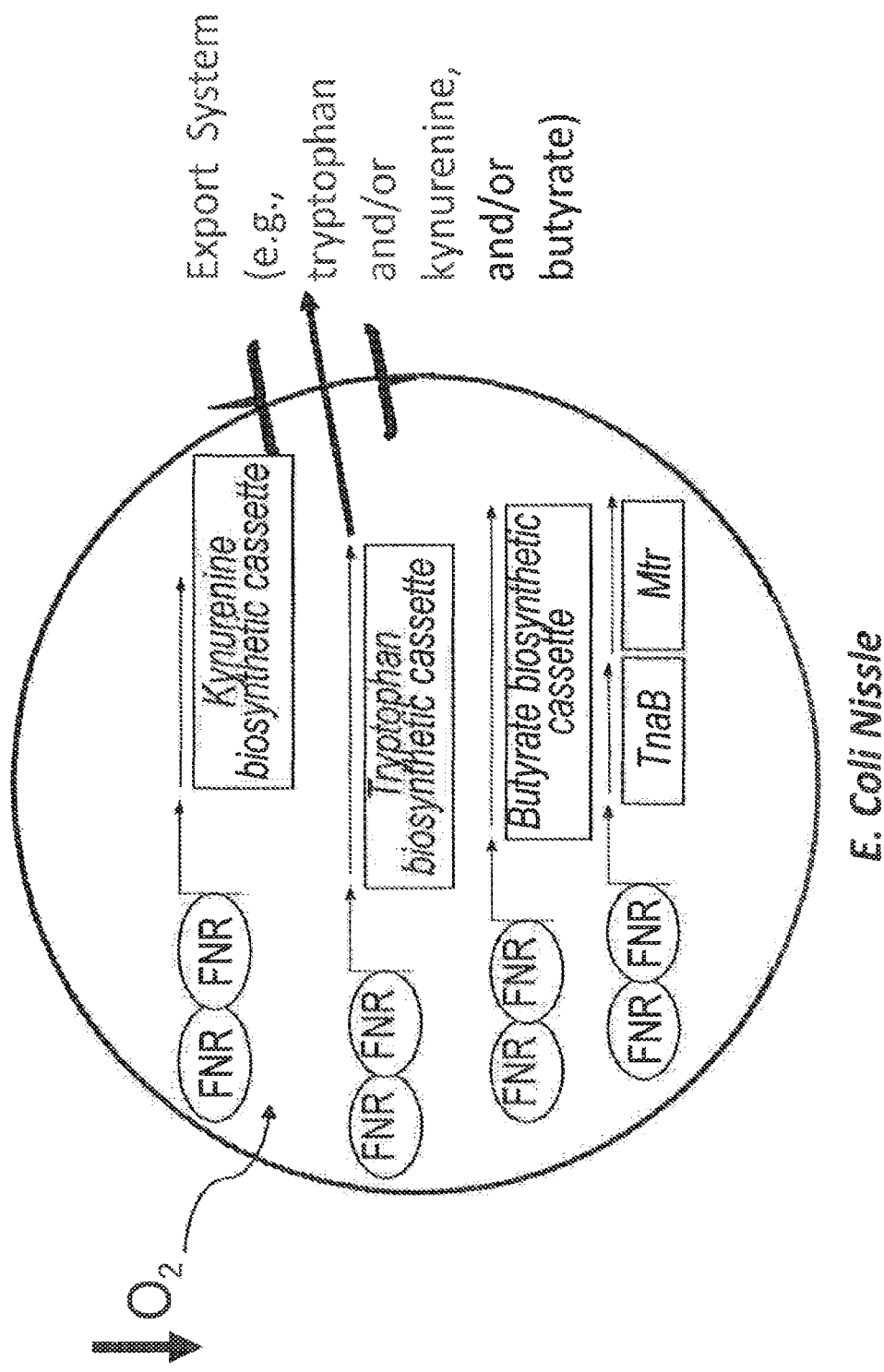
FIG. 44 depicts a schematic of an *E. coli* that is genetically engineered to produce kynurenine, butyrate, and tryptophan (which can be converted to kynurenine or exported), under the control of a FNR-responsive promoter and further comprising a secretion system as known in the art or described herein. A tryptophan transporter for import of tryptophan also expressed. Export mechanism for kynurenine is also expressed or provided.
Figure 45:
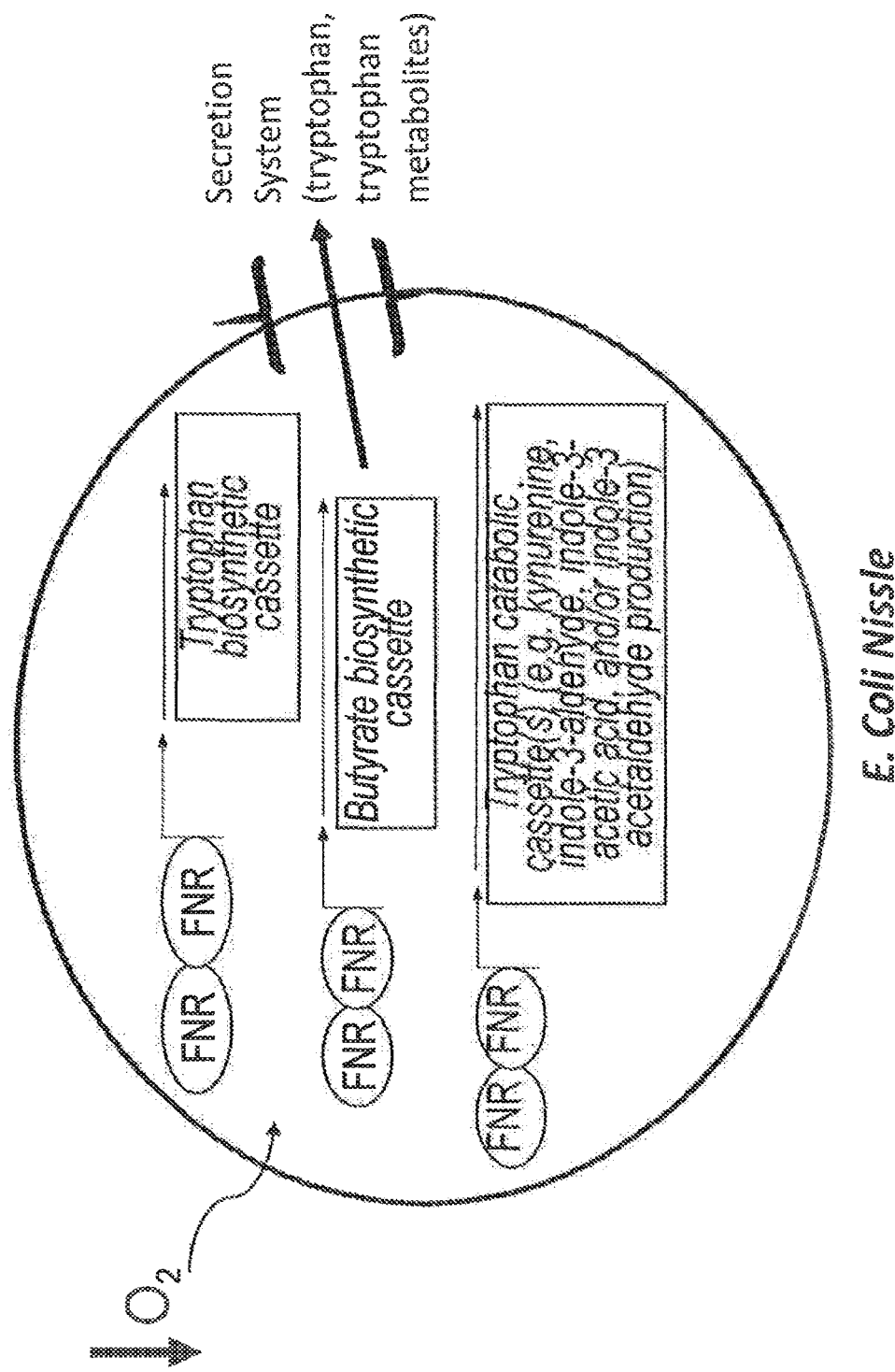
FIG. 45 depicts a schematic of an *E. coli* that is genetically engineered to produce butyrate, tryptophan metabolites, and tryptophan (which can be converted to bioactive tryptophan metabolites or exported), under the control of a FNR-responsive promoter and further comprising a secretion system as known in the art or described herein. Export mechanism for tryptophan and/or tryptophan metabolites is also expressed or provided.
Figure 46:
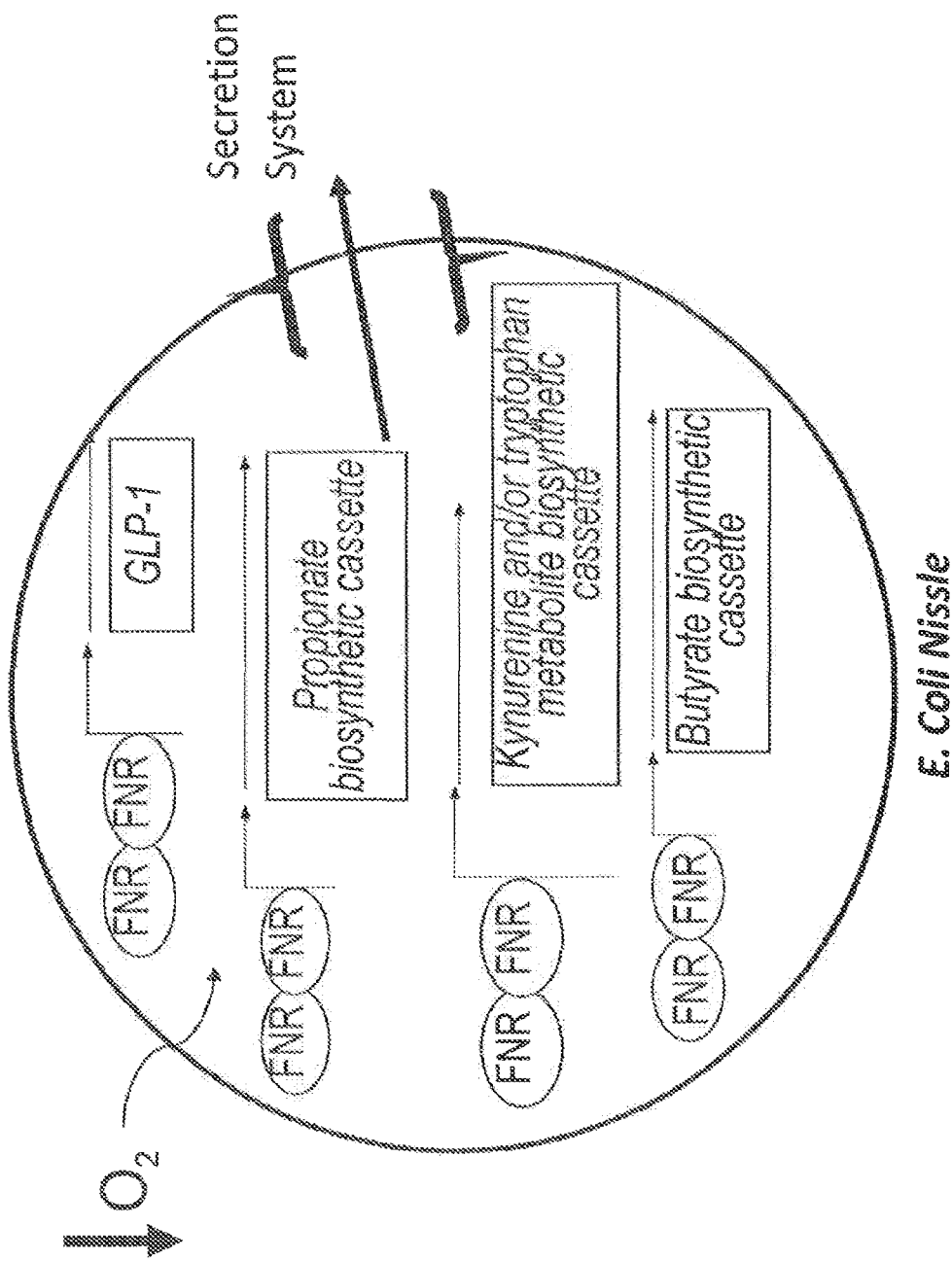
FIG. 46 depicts a schematic of an *E. coli* that is genetically engineered to produce butyrate, and propionate, kynurenine and/or other tryptophan metabolites, and GLP-1, under the control of a FNR-responsive promoter and further comprising a secretion system, e.g., for GLP-1 secretion as known in the art or described herein. Export mechanism for kynurenine/or tryptophan metabolites is also expressed or provided.

More recently, additional tryptophan metabolites, some of which are generated by the microbiota, some by the human host, which are also able to function as AhR agonists, see e.g., Table 13 and FIG. 32 and elsewhere herein, and Lama et al., Nat Med. 2016 June; 22(6):598-605; CARD9 impacts colitis by altering gut microbiota metabolism of tryptophan into aryl hydrocarbon receptor ligands.

In humans, the rate-limiting conversion of TRP to KYN may be mediated by either of two forms of indoleamine 2, 3-dioxygenase (IDO) or by tryptophan 2,3-dioxygenase (TDO). Along one side arm, KYN may be further metabolized to another bioactive metabolite, kynurenic acid, (KYNA) which can antagonize glutamate receptors and is generally considered neuroprotective or along a second arm to 3-hydroxykynurenine (3-HK). Along a third side arm of the KP, KYN can be converted to anthranilic acid (AA) and further downstream quinolinic acid (QUIN), which is a glutamate receptor agonist and has a neurotoxic role. Consequently, the KP has two responsibilities in regard to TRP in the body; it depletes serum levels of TRP and converts TRP into other biologically active metabolites. These metabolites, along with the enzymes responsible for their production, have implications in a broad range of diseases, including, but not limited to, various neurological conditions, metabolic syndrome, and associated cardiovascular disorders, obesity and diabetes.

Therefore, finding a means to upregulate and/or downregulate the levels of flux through the KP and to reset relative amounts and/or ratios of tryptophan and its various bioactive metabolites may be useful in the prevention, treatment and/or management of a number of diseases as described herein. The present disclosure describes compositions for modulating, regulating and fine tuning trypophan and tryptophan metabolite levels, e.g., in the serum or in the gastrointestinal system, through genetically engineered bacteria which comprise circuitry enabling the synthesis, bacterial uptake and catabolism of tryptophan and/or tryptophan metabolites. and provides methods for using these compositions in the treatment, management and/or prevention of a number of different diseases.

Methoxyindole Pathway, Serotonin and Melatonin

The methoxyindole pathway leads to formation of serotonin (5-HT) and melatonin. Serotonin (5-hydroxytryptamine, 5-HT) is a biogenic amine synthesized in a two-step enzymatic reaction: First, enzymes encoded by one of two tryptophan hydroxylase genes (Tph1 or Tph2) catalyze the rate-limiting conversion of tryptophan to 5-hydroxytryptophan (5-HTP), thus allocating the bioactivity of serotonin into either the brain (Tph2) or the periphery (Tph1). Then, 5-HTP undergoes decarboxylation to serotonin. Intestinal serotonin (5-hydroxytryptamine, 5-HT) is released by enterochromaffin cells and neurons and is regulated via the serotonin re-uptake transporter (SERT). The SERT is located on epithelial cells and neurons in the intestine. In certain embodiments, the genetically engineered bacteria described herein may modulate serotonin levels in the intestine, e.g., decrease serotonin levels.

5-HT also functions a substrate for melatonin biosynthesis. The rate-limiting step of melatonin biosynthesis is 5-HT-N-acetylation resulting in the formation of N-acetylserotonin (NAS) with subsequent Omethylation into 5-methoxy-N-acetyltryptamine (melatonin). The deficient production of 5-HT, NAS, and melatonin contribute to depressed mood, disturbances of sleep and circadian rhythms. Melatonin acts as a neurohormone and is associated with the development of circadian rhythm and the sleep-wake cycle.

In certain embodiments, the genetically engineered bacteria influence 5-HT synthesis, release, and/or degradation. Gut microbiota are interconnected with serotonin signaling and care capable of increasing serotonin levels through host serotonin production (Jano et al., Cell. 2015 Apr. 9; 161(2): 264-76. doi: 10.1016/j.cell.2015.02.047. Indigenous bacteria from the gut microbiota regulate host serotonin biosynthesis). In some embodiments, the genetically engineered bacteria may modulate the serotonin levels in the gut to ameliorate symptoms of a metabolic disease. In some embodiments, the genetically engineered bacteria take up serotonin from the environment, e.g., the gut. In a non limiting example, serotonin can be converted to melatonin by, e.g., TPH, tryptophan hydroxylase, HIOMT, hydroxyl-O-methyltransferase NAT, N-acetyltransferase, AAAD: aromatic—amino acid decarboxylase. In some embodiments, the genetically engineered influence serotonin levels produced by the host.

In bacteria, melatonin is synthesized indirectly with tryptophan as an intermediate product of the shikimic acid pathway. In these cells, synthesis starts with d-erythrose-4-phosphate and phosphoenolpyruvate. In some embodiments the genetically engineered bacteria comprise an endogenous or exogenous cassette for the production of melatonin. As anon-limiting example, the cassette is described in Bochkov, Denis V.; Sysolyatin, Sergey V.; Kalashnikov, Alexander I.; Surmacheva, Irina A. (2011). "Shikimic acid: review of its analytical, isolation, and purification techniques from plant and microbial sources". Journal of Chemical Biology 5 (1): 5-17. doi:10.1007/s12154-011-0064-8.

IDO, and TDO

One characteristic of TRP metabolism is that the rate-limiting step of the catalysis from TRP to KYN is generated by both the hepatic enzyme tryptophan 2,3-dioxygenase (TDO) and the ubiquitous expressed enzyme IDO1]. TDO is essential for homeostasis of TRP concentrations in organisms and has a lower affinity to TRP than IDO1. Its expression is activated mainly by increased plasma TRP concentrations but can also be activated by glucocorticoids and glucagon.

Figure 27:
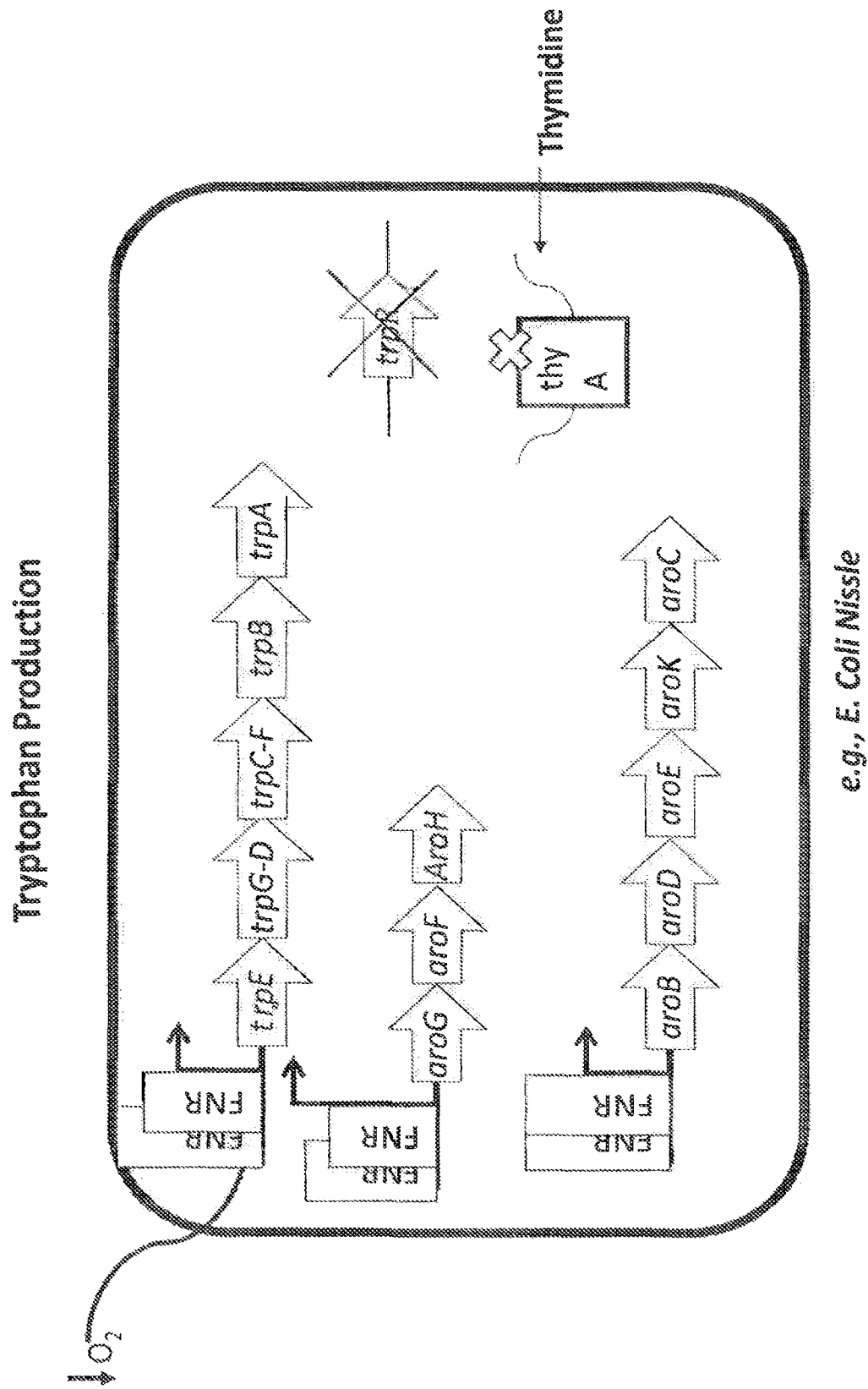
FIG. 27 shows a schematic depicting an exemplary Tryptophan circuit. Tryptophan is produced from the Chorismate precursor through expression of the trpE, trpG-D, trpC-F, trpB and trpA genes. Optional knockout of the tryptophan Repressor trpR is also depicted. Optional production of the Chorismate precursor through expression of aroG/F/H and aroB, aroD, aroE, aroK and aroC genes is also shown. All of these genes are optionally expressed from an inducible promoter, e.g., a FNR-inducible promoter. The bacteria may also include an auxotrophy, e.g., deletion of thyA (Δ thyA; thymidine dependence). The bacteria may also include gene sequence(s) for yddG to express YddG to assist in the exportation of tryptophan. Non limiting example of a bacterial strain is listed.

The tryptophan kynurenine pathway is also expressed in a large number of microbiota, most prominently in Enterobacteriaceae, and kynurenine and metabolites may be synthesized in the gut (FIG. 27 and Sci Transl Med. 2013 Jul. 10; 5(193): 193ra91). In some embodiments, the genetically engineered bacteria comprise one or more heterologous bacterially derived genes from Enterobacteriaceae.

Other Indole Tryptophan Metabolites

In addition to kynurenine and KYNA, numerous compounds have been proposed as endogenous AHR ligands, many of which are generated through pathways involved in the metabolism of the amino acid tryptophan and indole (Bittinger et al., 2003; Chung and Gadupudi, 2011) A large number of metabolites generated through the tryptophan indole pathway are generated by microbiota in the gut. For example bacteria take up tryptophan, which. can be converted to mono-substituted indole compounds, such as indole acetic acid (IAA) and tryptamine, and other compounds, which have been found to activate the AHR (Hubbard et al., 2015, Adaptation of the human aryl hydrocarbon receptor to sense microbiota-derived indoles; Nature Scientific Reports 5:12689). Table 13 lists exemplary tryptophan metabolites which have been shown to bind to AHR and which can be produced by the genetically engineered bacteria of the disclosure.

TABLE 13

Indole Tryptophan Metabolites

| Origin | Compound |
| --- | --- |
| Exogenous | 2, 3, 7, 8-Tetrachlorodibenzo-p-dioxin (TCDD) |
| Dietary | Indole-3-carbinol (I3C) |
| Dietary | Indole-3-acetonitrile (I3ACN) |
| Dietary | 3.3'-Diindolylmethane (DIM) |
| Dietary | 2-(indol-3-ylmethyl)-3.3'-diindolylmethane (Ltr-1) |
| Dietary | Indolo(3,2-b)carbazole (ICZ) |
| Dietary | 2-(1'H-indole-3'-carbony)-thiazole-4-carboxylic acid methyl ester (ITE) |
| Microbial | Indole |
| Microbial | Indole-3-acetic acid (IAA) |
| Microbial | Indole-3-aldehyde (IAId) |
| Microbial | Tryptamine |
| Microbial | 3-methyl-indole (Skatole) |
| Yeast | Tryptanthrin |
| Microbial/Host Metabolism | Indigo |
| Microbial/Host Metabolism | Indirubin |
| Microbial/Host Metabolism | Indoxyl-3-sulfate (I3S) |
| Host Metabolism | Kynurenine (Kyn) |
| Host Metabolism | Kynurenic acid (KA) |
| Host Metabolism | Xanthurenic acid |
| Host Metabolism | Cinnabarinic acid (CA) |
| UV-Light Oxidation | 6-formylindolo(3, 2-b) carbazole (FICZ) |

Tryptophan and Tryptophan Metabolite Circuits

Decreasing Exogenous Tryptophan

In some embodiments, the genetically engineered bacteria are capable of decreasing the level of tryptophan and/or the level of a tryptophan metabolite. In some embodiments, the engineered bacteria comprise gene sequence(s) for encoding one or more aromatic amino acid transporter(s). In one embodiment, the amino acid transporter is a tryptophan transporter. Tryptophan transporters may be expressed or modified in the recombinant bacteria described herein in order to enhance tryptophan transport into the cell. Specifically, when the tryptophan transporter is expressed in the recombinant bacterial cells described herein, the bacterial cells import more tryptophan into the cell when the transporter is expressed than unmodified bacteria of the same bacterial subtype under the same conditions. Thus, the genetically engineered bacteria comprising a heterologous gene encoding a tryptophan transporter which may be used to import tryptophan into the bacteria.

The uptake of tryptophan into bacterial cells is mediated by proteins well known to those of skill in the art. For example, three different tryptophan transporters, distinguishable on the basis of their affinity for tryptophan have been identified in E. coli (see, e.g., Yanofsky et al. (1991) J. Bacteriol. 173: 6009-17). The bacterial genes mtr, aroP, and tnaB encode tryptophan permeases responsible for tryptophan uptake in bacteria. High affinity permease, Mtr, is negatively regulated by the trp repressor and positively regulated by the TyR product (see, e.g., Yanofsky et al. (1991) J. Bacteriol. 173: 6009-17 and Heatwole et al. (1991) J. Bacteriol. 173: 3601-04), while AroP is negatively regulated by the tyR product (Chye et al. (1987) J. Bacteriol. 169:386-93).

In one embodiment, the at least one gene encoding a tryptophan transporter is a gene selected from the group consisting of mtr, aroP and tnaB. In one embodiment, the bacterial cell described herein has been genetically engineered to comprise at least one heterologous gene selected from the group consisting of mtr, aroP and tnaB. In one embodiment, the at least one gene encoding a tryptophan transporter is the Escherichia coli mtr gene. In one embodiment, the at least one gene encoding a tryptophan transporter is the Escherichia coli aroP gene. In one embodiment, the at least one gene encoding a tryptophan transporter is the Escherichia coli tnaB gene.

In some embodiments, the tryptophan transporter is encoded by a tryptophan transporter gene derived from a bacterial genus or species, including but not limited to, Escherichia, Corynebacterium, Escherichia coli, Saccharomyces cerevisiae or Corynebacterium glutamicum. In some embodiments, the bacterial species is Escherichia coli. In some embodiments, the bacterial species is Escherichia coli strain Nissle.

Assays for testing the activity of a tryptophan transporter, a functional variant of a tryptophan transporter, or a functional fragment of transporter of tryptophan are well known to one of ordinary skill in the art. For example, import of tryptophan may be determined using the methods as described in Shang et al. (2013) J. Bacteriol. 195:5334-42, the entire contents of each of which are expressly incorporated by reference herein.

In one embodiment, when the tryptophan transporter is expressed in the recombinant bacterial cells described herein, the bacterial cells import 10% more tryptophan into the bacterial cell when the transporter is expressed than unmodified bacteria of the same bacterial subtype under the same conditions. In another embodiment, when the tryptophan transporter is expressed in the recombinant bacterial cells described herein, the bacterial cells import 20%, 30%, 40%, 50%, 60%, 70%, 80%, 90% or 100% more tryptophan into the bacterial cell when the transporter is expressed than unmodified bacteria of the same bacterial subtype under the same conditions. In yet another embodiment, when the tryptophan transporter is expressed in the recombinant bacterial cells described herein, the bacterial cells import two-fold more tryptophan into the cell when the transporter is expressed than unmodified bacteria of the same bacterial subtype under the same conditions. In yet another embodiment, when the tryptophan transporter is expressed in the recombinant bacterial cells described herein, the bacterial cells import three-fold, four-fold, five-fold, six-fold, seven-fold, eight-fold, nine-fold, ten-fold, fifteen-fold, twenty-fold, thirty-fold, forty-fold, or fifty-fold, more tryptophan into the cell when the transporter is expressed than unmodified bacteria of the same bacterial subtype under the same conditions.

In addition to the tryptophan uptake transporters, in some embodiments, the genetically engineered bacteria further comprise a circuit for the production of tryptophan metabolites, as described herein, e.g., for the production of kynurenine, kynurenine metabolites, or indole tryptophan metabolites as shown in Table 13.

In some embodiments, the genetically engineered bacteria are capable of decreasing the level of tryptophan. In some embodiments, the engineered bacteria comprises one or more gene sequences for converting tryptophan to kynurenine. In some embodiments, the engineered bacteria comprises gene sequence(s) for encoding the enzyme indoleamine 2,3-dioxygenase (IDO-1). In some embodiments, the engineered bacteria comprises gene sequence(s) for encoding the enzyme tryptophan dioxygenase (TDO). In some embodiments, the engineered bacteria comprises gene sequence(s) for encoding the enzyme indoleamine 2,3-dioxygenase (IDO-1) and the enzyme tryptophan dioxygenase (TDO). In some embodiments, the genetically engineered bacteria comprise a gene cassette encoding Indoleamine 2, 3 dioxygenase (EC 1.13.11.52; producing N-formyl kynurenine from tryptophan) and Kynurenine formamidase (EC3.5.1.9) producing kynurenine from n-formylkynurenine). In some embodiments, the enzymes are bacterially derived, e.g., as described in Vujkovi-Cvijin et al. 2013.

Increasing Kynurenine

In some embodiments, the genetically engineered bacteria are capable of producing kynurenine.

In some embodiments, the genetically engineered bacteria are capable of decreasing the level of tryptophan. In some embodiments, the engineered bacteria comprises one or more gene sequences for converting tryptophan to kynurenine. In some embodiments, the engineered bacteria comprises gene sequence(s) for encoding the enzyme indoleamine 2,3-dioxygenase (IDO-1). In some embodiments, the engineered bacteria comprises gene sequence(s) for encoding the enzyme tryptophan dioxygenase (TDO). In some embodiments, the engineered bacteria comprise on or more gene sequence(s) for encoding the enzyme indoleamine 2,3-dioxygenase (IDO-1) and the enzyme tryptophan dioxygenase (TDO). In some embodiments, the genetically engineered bacteria comprise a gene cassette encoding Indoleamine 2, 3 dioxygenase (EC 1.13.11.52; producing N-formyl kynurenine from tryptophan) and Kynurenine formamidase (EC3.5.1.9) producing kynurenine from n-formylkynurenine). In some embodiments, the enzymes are bacterially derived, e.g., as described in Vujkovi-Cvijin et al. 2013.

The genetically engineered bacteria may comprise any suitable gene for producing kynurenine. In some embodiments, the gene for producing kynurenine is modified and/or mutated, e.g., to enhance stability, increase kynurenine production, and/or increase anti-inflammatory potency under inducing conditions. In some embodiments, the engineered bacteria also have enhanced uptake or import of tryptophan, e.g., comprise a transporter or other mechanism for increasing the uptake of tryptophan into the bacterial cell, as discussed in detail above. In some embodiments, the genetically engineered bacteria are capable of producing kynurenine under inducing conditions, e.g., under a condition(s) associated with inflammation. In some embodiments, the genetically engineered bacteria are capable of producing kynurenine in low-oxygen conditions, in the presence of certain molecules or metabolites, in the presence of molecules or metabolites associated with liver damage, metabolic disease, inflammation or an inflammatory response, or in the presence of some other metabolite that may or may not be present in the gut, such as arabinose.

In some embodiments, the genetically engineered bacteria are capable of producing kynurenic acid. Kynurenic acid is produced from the irreversible transamination of kynurenine in a reaction catalyzed by the enzyme kynurenine-oxoglutarate transaminase. The genetically engineered bacteria may comprise any suitable gene for producing kynurenic acid. In some embodiments, the gene for producing kynurenic acid is modified and/or mutated, e.g., to enhance stability, increase kynurenic acid production, and/or increase anti-inflammatory potency under inducing conditions. In some embodiments, the genetically engineered bacteria are capable of producing kynurenic acid under inducing conditions, e.g., under a condition(s) associated with inflammation. In some embodiments, the genetically engineered bacteria are capable of producing kynurenic acid in low-oxygen conditions, in the presence of certain molecules or metabolites, in the presence of molecules or metabolites associated with liver damage, metabolic disease, inflammation or an inflammatory response, or in the presence of some other metabolite that may or may not be present in the gut, such as arabinose.

In some embodiments, the genetically engineered bacteria comprise one or more gene(s) or gene cassette(s) for the consumption of tryptophan and production of kynurenine, which are bacterially derived. In some embodiments, the enzymes for TRP to KYN conversion are derived from one or more of *Pseudomonas, Xanthomonas, Burkholderia, Stenotrophomonas, Shewanella*, and *Bacillus*, and/or members of the families Rhodobacteraceae, Micrococcaceae, and Halomonadaceae, In some embodiments the enzymes are derived from the species listed in table S7 of Vujkovic-Cvijin et al. (Dysbiosis of the gut microbiota is associated with HIV diseaseprogression and tryptophan catabolism Sci Transl Med. 2013 Jul. 10; 5(193): 193ra91), the contents of which is herein incorporated by reference in its entirety.

In some embodiments, the one or more genes for producing kynurenine are modified and/or mutated, e.g., to enhance stability, increase kynurenine production, and/or increase anti-inflammatory potency under inducing conditions. In some embodiments, the engineered bacteria have enhanced uptake or import of tryptophan, e.g., comprise a transporter or other mechanism for increasing the uptake of tryptophan into the bacterial cell. In some embodiments, the genetically engineered bacteria are capable of producing kynurenine under inducing conditions, e.g., under a condition(s) associated with inflammation. In some embodiments, the genetically engineered bacteria are capable of producing kynurenine in low-oxygen conditions, in the presence of certain molecules or metabolites, in the presence of molecules or metabolites associated with liver damage, metabolic disease, inflammation or an inflammatory response, or in the presence of some other metabolite that may or may not be present in the gut, such as arabinose. In some embodiments, the genetically engineered bacteria are capable of producing kynurenic acid. Kynurenic acid is produced from the irreversible transamination of kynurenine in a reaction catalyzed by the enzyme kynurenine-oxoglutarate transaminase. In some embodiments, The genetically engineered bacteria may comprise any suitable gene for producing kynurenic acid. In some embodiments, the gene for producing kynurenic acid is modified and/or mutated, e.g., to enhance stability, increase kynurenic acid production, and/or increase anti-inflammatory potency under inducing conditions. In some embodiments, the genetically engineered bacteria are capable of producing kynurenic acid under inducing conditions, e.g., under a condition(s) associated with inflammation. In some embodiments, the genetically engineered bacteria are capable of producing kynurenic acid in low-oxygen conditions, in the presence of certain molecules or metabolites, in the presence of molecules or metabolites associated with liver damage, metabolic disease, inflammation or an inflammatory response, or in the presence of some other metabolite that may or may not be present in the gut, such as arabinose.

In some embodiments, the genetically engineered bacteria prevent the accumulation of post-kynurenine KP metabolites, e.g., neurotoxic metabolites, or diabetogenic metabolites. In some embodiments, the genetically engineered bacteria encode Kynureninase from *Pseudomonas fluorescens*.

In some embodiments, the genetically engineered bacteria comprising one or more gene(s) or gene cassette(s) can alter the TRP:KYN ratio, e.g. in the circulation. In some embodiments the TRP:KYN ratio is increased. In some embodiments, TRP:KYN ratio is decreased. In some embodiments, the genetically engineered bacteria the genetically engineered bacteria comprising one or more gene(s) or gene cassette(s) can alter the KYNA:QUIN ratio, e.g., in the brain.

In some embodiments, the genetically engineered bacteria are capable of expressing any one or more of the described circuits in low-oxygen conditions, in the presence of disease or tissue specific molecules or metabolites, in the presence of molecules or metabolites associated with inflammation or an inflammatory response or immune suppression, liver damage, or metabolic disease, or in the presence of some other metabolite that may or may not be present in the gut or the tumor micorenvironment, such as arabinose. In some embodiments, any one or more of the described circuits are present on one or more plasmids (e.g., high copy or low copy) or are integrated into one or more sites in the bacterial chromosome. Also, in some embodiments, the genetically engineered bacteria are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, and (6) combinations of one or more of such additional circuits.

Increasing Exogenous Tryptophan

In some embodiments, the genetically engineered microorganisms of the present disclosure, are capable of producing tryptophan.

In some embodiments, the genetically engineered bacteria that produce tryptophan comprise one or more gene sequences encoding one or more enzymes of the tryptophan biosynthetic pathway. In some embodiments, the genetically engineered bacteria comprise a tryptophan operon. In some embodiments, the genetically engineered bacteria comprise the tryptophan operon of *E. coli*. (Yanofsky, RNA (2007), 13:1141-1154). In some embodiments, the genetically engineered bacteria comprise the tryptophan operon of *B. subtilis*. (Yanofsky, RNA (2007), 13:1141-1154). In some embodiments, the genetically engineered bacteria comprise sequence(s) encoding trypE, trypG-D, trypC-F, trypB, and trpA genes. In some embodiments, the genetically engineered bacteria comprise sequence(s) encoding trypE, trypG-D, trypC-F, trypB, and trpA genes from *E. coli*. In some embodiments, the genetically engineered bacteria comprise sequence(s) encoding trypE, trypD, trypC, trypF, trypB, and trpA genes from *B. subtilis*. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, chorismate. Thus, in some embodiments, the genetically engineered bacteria optionally comprise sequence(s) encoding aroG, aroF, aroH, aroB, aroD, aroE, aroK, and AroC. In some embodiments, the genetically engineered bacteria comprise one or more gene sequences encoding one or more enzymes of the tryptophan biosynthetic pathway and one or more gene sequences encoding one or more enzymes of the chorismate biosynthetic pathway. In some embodiments, the genetically engineered bacteria comprise sequence(s) encoding trypE, trypG-D, trypC-F, trypB, and trpA genes from *E. coli* and sequence(s) encoding aroG, aroF, aroH, aroB, aroD, aroE, aroK, and AroC genes. In some embodiments, the genetically engineered bacteria comprise sequence(s) encoding trypE, trypD, trypC, trypF, trypB, and trpA genes from *B. subtilis* and sequence(s) encoding aroG, aroF, aroH, aroB, aroD, aroE, aroK, and AroC genes.

The inner membrane protein YddG of *Escherichia coli*, encoded by the yddG gene, is a homologue of the known amino acid exporters RhtA and YdeD. Studies have shown that YddG is capable of exporting aromatic amino acids, including tryptophan. Thus, YddG c an function as a tryptophan exporter or a tryptophan secretion system (or tryptophan secretion protein). Other aromatic amino acid exporters are described in Doroshenko et al., FEMS Microbial Lett., 275:312-318 (2007). Thus, in some embodiments, the engineered bacteria optionally further comprise gene sequence(s) encoding YddG. In some embodiments, the engineered bacteria can over-express YddG. In some embodiments, the engineered bacteria optionally comprise one or more copies of yddG gene.

As discussed above, studies have shown that the binding of kynurenine to the aryl hydrocarbon receptor results in the production of regulatory T cells (Tregs). Thus, in some embodiments, the genetically engineered bacteria comprise a mechanism for metabolizing or degrading kyurenine. In some embodiments, the genetically engineered bacteria comprise sequence encoding the enzyme kynureninase. Kynureninase is produced to metabolize Kynurenine to Anthranilic acid in the cell. Schwarcz et al., Nature Reviews Neuroscience, 13, 465-477; 2012; Chen & Guillemin, 2009; 2; 1-19; Intl. J. Tryptophan Res. Exemplary kynureninase sequences are provided herein below in Table 3. In some embodiments, the engineered microbe has a mechanism for importing (transporting) Kynurenine from the local environment into the cell. Thus, in some embodiments, the genetically engineered bacteria comprise gene sequence(s) encoding a kynureninase secreter. In some embodiments, the genetically engineered bacteria comprise one or more copies of aroP, tnaB or mtr gene.

In some embodiments, the genetically engineered bacteria comprise gene sequence(s) encoding enzymes of the tryptophan biosynthetic pathway and sequence encoding kynureninase. In some embodiments, the genetically engineered bacteria comprise a tryptophan operon, for example that of *E. coli*. or *B. subtilis*, and sequence encoding kynureninase. In some embodiments, the genetically engineered bacteria comprise sequence(s) encoding trypE, trypG-D, trypC-F, trypB, and trpA genes, for example, from *E. coli* and sequence encoding kyureninase. In some embodiments, the genetically engineered bacteria comprise sequence(s) encoding trypE, trypD, trypC, trypF, trypB, and trpA genes, for example from *B. subtilis* and sequence encoding kyureninase. In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, for example, sequence(s) encoding aroG, aroF, aroH, aroB, aroD, aroE, aroK, and AroC. Thus, in some embodiments, the genetically engineered bacteria comprise sequence(s) encoding trypE, trypG-D, trypC-F, trypB, and trpA genes from *E. coli*, sequence(s) encoding aroG, aroF, aroH, aroB, aroD, aroE, aroK, and AroC genes, and sequence encoding kyureninase. In some embodiments, the genetically engineered bacteria comprise sequence(s) encoding trypE, trypD, trypC, trypF, trypB, and trpA genes from *B. subtilis*, sequence(s) encoding aroG, aroF, aroH, aroB, aroD, aroE, aroK, and AroC genes, and sequence encoding kyureninase. In any of these embodiments, the genetically engineered bacterium may further comprise gene sequence for exporting or secreting tryptophan from the cell. Thus, in some embodiments, the engineered bacteria further comprise gene sequence(s) encoding YddG. In some embodiments, the engineered bacteria can over-express YddG. In some embodiments, the engineered bacteria optionally comprise one or more copies of yddG gene. In any of these embodiments, the genetically engineered bacterium may further comprise gene sequence for importing or transporting kynurenine into the cell. Thus, in some embodiments, the genetically engineered bacteria comprise gene sequence(s) encoding a kynureninase secreter. In some embodiments, the genetically engineered bacteria comprise one or more copies of aroP, tnaB or mtr gene.

In some embodiments, the genetically engineered bacterium or genetically engineered microorganism comprises one or more genes for producing tryptophan and/or kynureninase, under the control of a promoter that is activated by low-oxygen conditions, by inflammatory conditions, liver damage, and. or metabolic disease, such as any of the promoters activated by said conditions and described herein. In some embodiments, the genetically engineered bacteria expresses one or more genes for producing tryptophan and/or kynureninase, under the control of a cancer-specific promoter, a tissue-specific promoter, or a constitutive promoter, such as any of the promoters described herein. Table 14 lists exemplary tryptophan synthesis cassettes encoded by the genetically engineered bacteria of the disclosure.

TABLE 14

Tyrptophan Synthesis Cassette Sequences

| Description | Sequence |
| --- | --- |
| Tet-regulated Tryptophan operon SEQ ID NO: 121 | taagacccactttcacatttaagttgtttttctaatccgcatatgatcaattcaaggccgaataagaagg<br>ctggctctgcaccttggtgatcaaataattcgatagcttgtcgtaataatggcggcatactatcagtag<br>taggtgtttcccctttcttctttagcgacttgatgctcttgatcttccaatacgcaacctaaagtaaaatgc<br>cccacagcgctgagtgcatataatgcattctctagtgaaaaaccttgttggcataaaaaggctaattg<br>attttcgagagtttcatactgttttttctgtaggccgtgtacctaaatgtacttttgctccatcgcgatgact<br>tagtaaagcacatctaaaacttttagcgttattacgtaaaaaatcttgccagctttccccttctaaaggg<br>caaaagtgagtatggtgcctatctaacatctcaatggctaaggcgtcgagcaaagcccgcttattttt<br>tacatgccaatacaatgtaggctgctctacacctagcttctgggcgagtttacgggttgttaaaccttc<br>gattccgacctcattaagcagctctaatgcgctgttaatcacttttactttttatctaatctagacatcatta<br>attcctaattttttgttgacactctatcattgatagagttattttaccactccctatcagtgatagagaaaag<br>tgaactctagaaataattttgtttaacttttaagaaggagatatacatatgcaaacacaaaaaccgactc<br>tcgaactgctaacctgcgaaggcgcttatcgcgacaacccgactgcgcttttttcaccagttgtgtgg<br>ggatcgtccggcaacgctgctgctggaatccgcagatatcgacagcaaagatgatttaaaaagcc<br>tgctgctggtagacagtgcgctgcgcattacagcattaagtgacactgtcacaatccaggcgctttc<br>cggcaatggagaagccctgttgacactactggataacgcctgcctgcgggtgtggaaaatgaac<br>aatcaccaaactgccgcgtactgcgcttcccgcctgtcagtccactgctggatgaagacgcccgct<br>tatgctcccttcggttttgacgctttccgcttattacagaatctgttgaatgtaccgaaggaagaacg<br>agaagcaatgttcttcggcggcctgttctcttatgaccttgtggcgggatttgaaaatttaccgcaact<br>gtcagcggaaaatagctgccctgatttctgtttttatctcgctgaaacgctgatggtgattgaccatca<br>gaaaaaagcactcgtattcaggccagcctgtttgctccgaatgaagaagaaaaacaacgtctcac<br>tgctcgcctgaacgaactacgtcagcaactgaccgaagccgcgccgctgccggtggtttcc<br>gtgccgcatatgcgttgtgaatgtaaccagagcgatgaagagttcggtggtgtagtgcgtttgttgc<br>aaaaagcgattcgcgccggagaaattttccaggtggtgccatctcgccgtttctctctgccctgccc<br>gtcaccgctggcagcctattacgtgctgaaaaagagtaatcccagcccgtacatgttttttatgcag<br>gataatgatttcaccctgtttggcgcgtcgccggaaagttcgctcaagtatgacgccaccagccgc<br>cagattgagatttacccgattgccggaacacgtccacgcggtcgtcgtgccgatggttcgctggac<br>agagacctcgacagccgcatcgaactggagatgcgtaccgatcataaagagcttctgaacatctg<br>atgctggtggatctcgcccgtaatgacctggcacgcatttgcacacccggcagccgctacgtcgc<br>cgatctcaccaaagttgaccgttactcttacgtgatgcacctagtctcccgcgttgttggtgagctgc<br>gccacgatctcgacgccctgcacgcttaccgcgcctgtatgaatatggggacgttaagcggtgca<br>ccgaaagtacgcgctatgcagttaattgccgaagcagaaggtcgtcgacgcggcagctacggcg<br>gcgcggtaggttattttaccgcgcatggcgatctcgacacctcgattgtgatccgctcggcgctggt<br>ggaaaacggtatcgccaccgtgcaagccggtgctggcgtagtccttgattctgttccgcagtcgga<br>agccgacgaaactcgtaataaagcccgcgctgtactgcgcgctattgccaccgcgcatcatgcac<br>aggagacgttctaatggctgacattctgctgctcgataatatcgactcttttacgtacaacctggcag<br>atcagttgcgcagcaatggtcataacgtggtgatttaccgcaaccatattccggcgcagaccttaatt<br>gaacgcctggcgacgatgagcaatccggtgctgatgcttctcctggccccggtgtgccgagcga<br>agccggttgtatgccggaactcctcacccgcttgcgtggcaagctgccaattattggcatttgcctc<br>ggacatcaggcgattgtcgaagcttacgggggctatgtcggtcaggcgggcgaaattcttcacg<br>taaagcgtcgagcattgaacatgacggtcaggcgatgtttgccggattaacaaacccgctgccagt<br>ggcgcgttatcactcgctggttggcagtaacattccggccggtttaaccatcaacgcccatttaatg<br>gcatggtgatggcggtgcgtcacgatgcagatccgtttgtggattccagttccatccggacatccat<br>tcttactacccagggcgctcgcctgctggaacaaacgctggcctgggcgcagcagaaactagag<br>ccaaccaacacgctgcaaccgattctggaaaaactgtatcaggcacagacgcttagccaacaaga<br>aagccaccagctgtttttcagcggtggtacgtggcgagctgaagccggaacaactggcggcggc<br>gctggtgagcatgaaaattcgcggtgaacacccgaacgagatcgccggggcagcaaccgcgct<br>actggaaaacgccgcgccattcccgcgcccggattatctgtttgccgatatcgtcggtactggcgg<br>tgacggcagcaacagcatcaatatttctaccgccagtgcgtttgtcgccgcggcctgcgggctgaa<br>agtggcgaaacacggcaaccgtagcgctccagtaaatccggctcgtcggatctgctggcggcgt<br>tcggtattaatcttgatatgaaccgcgataaatcgccaggcgctggatgagttaggcgtctgtttc<br>ctctttgcgccgaagtatcacaccggattccgccatgccgatgccggttcgccagcaactgaaaacc<br>cgcactctgttcaacgtgctgggaccattgattaaccggcgcatccgccgctggcgctaattggt<br>gtttatagtccggaactggtgctgccgattgccgaaaccttgcgcgtgctggggtatcaacgcgcg<br>gcagtggtgcacagcggcgggatggatgaagtttcattacacgcgccgacaatcgttgccgaact<br>acatgacggcgaaattaagagctatcaattgaccgctgaagattttggcctgacaccctaccacca<br>ggagcaattggcaggcggaacaccggaagaaaaccgtgacattttaacacgcttgttacaaggta<br>aaggcgacgccgcccatgaagcagccgtcgcggcgaatgtcgccatgttaatgcgcctgcatgg<br>ccatgaagatctgcaagccaatgcgcaaaccgttcttgaggtactgcgcagtggttccgcttacga<br>cagagtcaccgcactggcggcacgagggtaaaatgatgcaaacgttttagccgaaaatcgtcgca<br>gacaaggcgatttgggtagaaacccgcaaagagcagcaaccgctggccagttttcagaatgagg<br>ttcagccgagcacgcgacatttttatgatgcacttcagggcgcacgcacggcgtttattctggagtg<br>taaaaaagcgtcgccgtcaaaaggcgtgatccgtgatgatttcgatccggcacgcattgccgccat<br>ttataaacattacgcttcggcaatttcagtgctgactgatgaaaatattttcagggagcgtttgatttc<br>ctccccatcgtcagccaaatcgccccgcagccgattttatgtaaagacttcattatcgatcctacca<br>gatctatctggcgcgctattaccaggccgatgcctgcttattaatgcttcagtactgatgacgaac<br>aatatcgccagcttgcagccgtcgcccacagtctggagatgggtgtgctgaccgaagtcagtaat<br>gaagaggaactggagcgcgccattgcattgggggcaaaggtcgttggcatcaacaaccgcgatc<br>tgcgcgatttgtcgattgatctcaaccgtacccgcgagcttgcgccgaaactggggcacaacgtga<br>cggtaatcagcgaatccggcatcaatacttacgctcaggtgcgcgagttaagccacttcgctaacg<br>gctttctgattggttcggcgttgatggcccatgacgatttgaacgccgcgtgcgtcgggtgttgctg<br>ggtgagaataaagtatggcctgacacgtgggcaagatgctaaagcagcttatgacgcgggcg<br>cgatttacggtgggttgattttttgttgcgacatcaccgcgttgcgtcaacgttgaacaggcgcagga<br>agtgatggctgcagcaccgttgcagtatgttggcgtgttccgcaatcacgatattgccgatgtggcg<br>gacaaagctaaggtgttatcgctggcggcagtgcaactgcatggtaatgaagatcagctgtatatc<br>gacaatctgcgtgaggctctgccagcacacgtcgccatctggaaggctttaagtgtcggtgaaact<br>cttcccgcgcgcgattttcagcacatcgataaatatgtattcgacaacggtcagggcgggagcgga |

TABLE 14-continued

Tyrptophan Synthesis Cassette Sequences

| Description | Sequence |
|---|---|
|  | caacgtttcgactggtcactattaaatggtcaatcgcttggcaacgttctgctggcgggggggcttag<br>gcgcagataactgcgtggaagcggcacaaaccggctgcgccgggcttgattttaattctgctgtag<br>agtcgcaaccgggtatcaaagacgcacgtcttttggcctcggttttccagacgctgcgcgcatatta<br>aggaaaggaacaatgacaacattacttaaccccctattttggtgagtttggcggcatgtacgtgccac<br>aaatcctgatgcctgctctgcgccagctggaagaagcttttgtcagcgcgcaaaaagatcctgaatt<br>tcaggctcagttcaacgacctgctgaaaaactatgccgggcgtccaaccgcgctgaccaaatgcc<br>agaacattacagccgggacgaacaccacgctgtatctgaagcgcgaagatttgctgcacgtgcgg<br>cgcgcataaaactaaccaggtgctcggtcaggctttactggcgaagcggatgggtaaaactgaaa<br>ttattgccgaaaccggtgccggtcagcatggcgtggcgtcggccctttgccagcgccctgctcggc<br>ctgaaatgccgaatttatatgggtgccaaagacgttgaacgccagtcgcccaacgttttccggatgc<br>gcttaatgggtgcggaagtgatcccggtacatagcggttccgcgaccctgaaagatgcctgtaatg<br>aggcgctacgcgactggtccggcagttatgaaaccgcgcactatatgctgggtaccgcagctggc<br>ccgcatccttacccgaccattgtgcgtgagtttcaagcggatgattggcgaagaaacgaaagcgca<br>gattctggaaagagaaggtcgcctgccggatgccgttatcgcctgtgttggcggtggttcgaatgc<br>catcggtatgtttgcagatttcatcaacgaaaccgacgtcggcctgattggtgtggagcctggcgg<br>ccacggtatcgaaactggcgagcacggcgcaccgttaaaacatggtcgcgtgggcatctatttcg<br>gtatgaaagcgcgatgatgcaaaccgaagacgggcaaattgaagagtcttactccattctgccg<br>ggctggattcccgtccgtcggcccgcaacatgcgtatctcaacagcactggacgcgctgattacg<br>tgtcgtattaccgacgatgaagccctggaagcctttaaaacgctttgcctgcatgaagggatcatccc<br>ggcgctggaatcctcccacgccctggcccatgcgctgaaaatgatgcgcgaaaatccggaaaaa<br>gagcagctactggtggttaaccttccggtcgcggcgataaagacatcttcaccgttcacgatatttt<br>gaaagcacgaggggaaatctgatggaacgctacgaatctctgtttgcccagttgaaggagcgcaa<br>agaaggcgcattcgttcctttcgtcaccctcggtgatccgggcattgagcagtcgttgaaaattatcg<br>atacgctaattgaagccggtgctgacgcgctggagttaggcatcccccttctccgacccactggcgg<br>atggcccgacgattcaaaacgccacactgcctgcttttgcggcgggagtaacccccggcgcagtg<br>cttttgagatgctggcactcattcgccagaagcacccgaccattcccatcggccttttgatgtatgcca<br>acctggtgtttaacaaaggcattgatgagttttatgccgagtcgcgagaaagtcggcgtcgattcggt<br>gctggttgccgatgtgcccgtggaagagtccgcgcccttccgccaggccgcgttgcgtcataatgt<br>cgcacctatctttatttgcccgccgaatgccgacgatgatttgctgcgccagatagcctcttacggtc<br>gtggttacacctatttgctgtcgcgagcgggcgtgaccggcgtagaaaaccgcgccgcgttaccc<br>ctcaatcatctcggttgcgaagctgaaagagtacaacgctgcgcctccattgcagggatttggtatttc<br>cgcccccggatcaggtaaaagccgcgattgatgcaggagctgcgggcgcgatttctggttcggcc<br>atcgttaaaatcatcgagcaacatattaatgagccagagaaatgctggcggcactgaaagcttttg<br>tacaaccgatgaaagcggcgacgcgcagttaatacgcatggcatggatgaCCGATGGTA<br>GTGTGGGGTCTCCCCATGCGAGAGTAGGGAACTGCCAGGC<br>ATCAAATAAAACGAAAGGCTCAGTCGAAAGACTGGGCCTT<br>TCGTTTTATCTGTTGTTTGTCGGTGAACGCTCTCCTGAGTAG<br>GACAAATCCGCCGGGAGCGGATTTGAACGTTGCGAAGCAA<br>CGGCCCGGAGGGTGGCGGGCAGGACGCCCGCCATAAACTG<br>CCAGGCATCAAATTAAGCAGAAGGCCATCCTGACGGATGG<br>CCTTTTTGCGTGGCCAGTGCCAAGCTTGCATGCGTGC |
| Tet repressor<br>SEQ ID<br>NO: 122 | taagacccactttcacatttaagttgtttttctaatccgcatatgatcaattcaaggccgaataagaagg<br>ctggctctgcaccttggtgatcaaataattcgatagcttgtcgtaataatggcggcatactatcagtag<br>taggtgtttcccctttcttcttagcgacttgatgctcttgatcttccaatacgcaacctaaagtaaaatgc<br>cccacagcgcgtgagtgcatataatgcattctctagtgaaaaaccttgttggcataaaaaaggctaattg<br>attttcgagagtttcatactgttttttctgtaggccgtgtacctaaatgtacttttgctccatcgcgatgact<br>tagtaaagcacatctaaaactttttagcgttattacgtaaaaaatcttgccagctttccccttctaaaggg<br>caaaagtgagtatggtgcctatctaacatctcaatggctaaggcgtcgagcaaagcccgcttattttt<br>tacatgccaatacaatgtaggctgctctacacctagcttctgggcgagtttacgggttgttaaaccttc<br>gattccgacctcattaagcagctctaatgcgctgttaatcactttacttttatctaatctagacat |
| tetR/tetA<br>promoters<br>and RBS and<br>leader region<br>SEQ ID NO<br>123: | cattaattcctaattttttgttgacactctatcattgatagagttattttaccactcctatcagtgatagag<br>aaaagtgaactctagaaataattttgtttaactttaagaaggagatatacat |
| trpE<br>SEQ ID<br>NO: 124 | atgcaaacacaaaaaccgactctcgaactgctaacctgcgaaggcgcttatcgcgacaacccgac<br>tgcgcttttttcaccagttgtgtgggatcgtccggcaacgctgctgctggaatccgcagatatcgac<br>agcaaagatgatttaaaaagcctgctgctggtagacagtgcgctgcgcattacagcattaagtgac<br>actgtcacaatccaggcgcttccggcaatggagaagccctgttgacactactggataacgccttg<br>cctgcgggtgtggaaaatgaacaatcaccaaactgccgcgtactcgcttcccgcctgtcagtcca<br>ctgctggatgaagacgcccgcttatgctcccttttcggttttttgacgctttccgcttattacagaatctgtt<br>gaatgtaccgaaggaagaacgagaagcaatgttcttcggcggcctgttctcttatgaccttgtggcg<br>ggatttgaaaatttaccgcaactgtcagcggaaaatagctgccctgattctgttttttatctcgctgaaa<br>cgctgatggtgattgaccatcagaaaaaaagcactcgtattcaggccagcctgtttgctccgaatga<br>agaagaaaacaacgtctcactgctcgcctgaacgaactacgtcagcaactgaccgaagccgcg<br>ccgccgctgccggtggtttccgtgccgcatatgcgttgtgaatgtaaccagagcgatgaagagttc<br>ggtggtgtagtgcgtttgttgcaaaaagcgattcgcgcgcggagaaattttccaggtggtgccatctc<br>gccgtttctctctgccctgccgtcaccgctggcagcctattacgtgctgaaaaagagtaatcccag<br>cccgtacatgtttttatgcaggataatgatttcacccctgtttggcgcgtcgccggaaagttcgctcaa<br>gtatgacgccaccagccgccagattgagatttacccgattgccggaacacgtccacgcggtcgtc<br>gtgccgatggttcgctggacagagacctcgacagccgcatcgaactggagatgcgtaccgatcat<br>aaagagctttctgaacatctgatgctggtggatctcgcccgtaatgacctggcacgcatttgcacac |

TABLE 14-continued

Tyrptophan Synthesis Cassette Sequences

| Description | Sequence |
|---|---|
| | ccggcagccgctacgtcgccgatctcaccaaagttgaccgttactcttacgtgatgcacctagtctc<br>ccgcgttgttggtgagctgcgccacgatctcgacgccctgcacgcttaccgcgcctgtatgaatat<br>ggggacgttaagcggtgcaccgaaagtacgcgctatgcagttaattgccgaagcagaaggtcgt<br>cgacgcggcagctacggcggcgcggtaggttattttaccgcgcatggcgatctcgacacctgcat<br>tgtgatccgctcggcgctggtggaaaacggtatcgccaccgtgcaagccggtgctggcgtagtcc<br>ttgattctgttccgcagtcggaagccgacgaaactcgtaataaagcccgcgctgtactgcgcgtat<br>tgccaccgcgcatcatgcacaggagacgttcta |
| TrpE<br>SEQ ID<br>NO: 125 | MQTQKPTLELLTCEGAYRDNPTALFHQLCGDRPATLLLESADI<br>DSKDDLKSLLLVDSALRITALSDTVTIQALSGNGEALLTLLDN<br>ALPAGVENEQSPNCRVLRFPPVSPLLDEDARLCSLSVFDAFRL<br>LQNLLNVPKEEREAMFFGGLFSYDLVAGFENLPQLSAENSCP<br>DFCFYLAETLMVIDHQKKSTRIQASLFAPNEEEKQRLTARLNE<br>LRQQLTEAAPPLPVVSVPHMRCECNQSDEEFGGVVRLLQKAI<br>RAGEIFQVVPSRRFSLPCPSPLAAYYVLKKSNPSPYMFFMQDN<br>DFTLFGASPESSLKYDATSRQIEIYPIAGTRPRGRRADGSLDRD<br>LDSRIELEMRTDHKELSEHLMLVDLARNDLARICTPGSRYVA<br>DLTKVDRYSYVMHLVSRVVGELRHDLDALHAYRACMNMGT<br>LSGAPKVRAMQLIAEAEGRRRGSYGGAVGYFTAHGDLDTCIV<br>IRSALVENGIATVQAGAGVVLDSVPQSEADETRNKARAVLRA<br>IATAHHAQETF |
| trpD<br>SEQ ID<br>NO: 126 | atggctgacattctgctgctcgataatatcgactcttttacgtacaacctggcagatcagttgcgcag<br>caatggtcataacgtggtgatttaccgcaaccatattccggcgcagaccttaattgaacgcctggcg<br>acgatgagcaatccggtgctgatgctttctcctggccccggtgtgccgagcgaagccggttgtatg<br>ccggaactcctcacccgcttgcgtggcaagctgccaattattggcatttgcctcggacatcaggcg<br>attgtcgaagcttacgggggctatgtcggtcaggcgggcgaaattcttcacggtaaagcgtcgag<br>cattgaacatgacggtcaggcgatgtttgccggattaacaaacccgctgccagtggcgcgttatca<br>ctcgctggttggcagtaacattccggccggtttaaccatcaacgcccatttaatggcatggtgatgg<br>cggtgcgtcacgatgcagatcgcgtttgtggattccagttccatccggaatccattcttactacccag<br>ggcgctcgcctgctggaacaaacgctggcctgggcgcagcagaaactagagccaaccaacacg<br>ctgcaaccgattctggaaaaactgtatcaggcacagacgcttagccaacaagaaagccaccagct<br>gttttcagcggtggtacgtggcgagctgaagccggaacaactggcggcggcgctggtgagcatg<br>aaaattcgcggtgaacacccgaacgagatcgccggggcagcaaccgctgaaaacgcc<br>gcgccattcccgcgccccggattatctgtttgccgatatcgtcggtactggcggtgacggcagcaac<br>agcatcaatatttctaccgccagtgcgtttgtcgccgcggcctgcgggctgaaagtggcgaaacac<br>ggcaaccgtagcgtctccagtaaatccggctcgtcggatctgctggcggcgttcggtattaatcttg<br>atatgaacgccgataaatcgcgccaggcgctggatgagttggcgtctgtttcctcttttgcgccgaa<br>gtatcacaccggattccgccatgcgatgccggttcgccagcaactgaaaacccgcactctgttcaa<br>cgtgctgggaccattgattaacccggcgcatccgccgctggcgctaattggtgtttatagtccggaa<br>ctggtgctgccgattgccgaaaccttgcgcgtgctggggtatcaacgcgcggcagtggtgcacag<br>cggcgggatggatgaagtttcattacacgcgccgacaatcgttgccgaactacatgacggcgaaa<br>ttaagagctatcaattgaccgctgaagattttggcctgacaccctaccaccaggagcaattggcag<br>gcggaacaccggaagaaaaccgtgacattttaacacgcttgttacaaggtaaaggcgacgccgc<br>ccatgaagcagccgtcgcggcgaatgtcgccatgttaatgcgcctgcatggccatgaagatctgc<br>aagccaatgcgcaaaccgttcttgaggtactgcgcagtggttccgcttacgacagagtcaccgca<br>ctggcggcacgagggtaa |
| TrpD<br>SEQ ID<br>NO: 127 | MADILLLLDNIDSFTYNLADQLRSNGHNVVIYRNHIPAQTLIERL<br>ATMSNPVLMLSPGPGVPSEAGCMPELLTRLRGKLPIIGICLGH<br>QAIVEAYGGYVGQAGEILHGKASSIEHDGQAMFAGLTNPLPV<br>ARYHSLVGSNIPAGLTINAHFNGMVMAVRHDADRVCGFQFH<br>PESILTTQGARLLEQTLAWAQQKLEPTNTLQPILEKLYQAQTL<br>SQQESHQLFSAVVRGELKPEQLAAALVSMKIRGEHPNEIAGA<br>ATALLENAAPFPRPDYLFADIVGTGGDGSNSINISTASAFVAA<br>ACGLKVAKHGNRSVSSKSGSSDLLAAFGINLDMNADKSRQAL<br>DELGVCFLFAPKYHTGFRHAMPVRQQLKTRTLFNVLGPLINP<br>AHPPLALIGVYSPELVLPIAETLRVLGYQRAAVVHSGGMDEVS<br>LHAPTIVAELHDGEIKSYQLTAEDFGLTPYHQEQLAGGTPEEN<br>RDILTRLLQGKGDAAHEAAVAANVAMLMRLHGHEDLQANA<br>QTVLEVLRSGSAYDRVTALAARG |
| trpC<br>SEQ ID<br>NO: 128 | atgcaaaccgttttagcgaaaatcgtcgcagacaaggcgatttgggtagaaacccgcaaagagca<br>gcaaccgctggccagttttcagaatgaggttcagccgagcacgcgacatttttatgatgcacttcag<br>ggcgcacgcacggcgtttattctggagtgtaaaaaagcgtcgccgtcaaaaggcgtgatccgtga<br>tgatttcgatccggcacgcattgccgccatttataaacattacgcttcggcaatttcagtgctgactga<br>tgagaaatattttcaggggagctttgatttcctcccccatcgtcagccaaatcgccccgcagccgattt<br>tatgtaaagacttcattatcgatcctttaccagatctatctggcgcgctattaccaggccgatgcctgct<br>tattaatgctttcagtactcggatgacgaacaatatcgccagcttgcagccgtcgccacagtctgga<br>gatgggtgtgctgaccgaagtcagtaatgaagaggaactggagcgcgccattgcattggggcga<br>aagtcgttggcatcaacaaccgcgatctgcgcgatttgtcgatttgatcctcaaccgtaccgcgcgag<br>cttgccgcgaaactggggcacaacgtgacggtaatcagcgaatccggcatcaatacttacgtcca<br>ggtcgcgagttaagccacttcgctaacgctttctgattggttcggcgttgatggcccatgacgatt<br>tgaacgccgccgtgcgtcgggtgttgctgggtgagaataaagtatgtggcctgacacgtgggcaa<br>gatgctaaagcagcttatgacgcgggcgcgatttacggtggggttgattttgttgcgacatcaccgc<br>gttgcgtcaacgttgaacaggcgcaggaagtgatggctgcagcaccgttgcagtatgttggcgtgt |

TABLE 14-continued

Tyrptophan Synthesis Cassette Sequences

| Description | Sequence |
|---|---|
| | tccgcaatcacgatattgccgatgtggcggacaaagctaaggtgttatcgctggcggcagtgcaa<br>ctgcatggtaatgaagatcagctgtatatcgacaatctgcgtgaggctctgccagcacacgtcgcc<br>atctggaaggctttaagtgtcggtgaaactcttcccgcgcgcgattttcagcacatcgataaatatgt<br>attcgacaacggtcagggcgggagcggacaacgtttcgactggtcactattaaatggtcaatcgct<br>tggcaacgttctgctggcgggggcttaggcgcagataactgcgtggaagcggcacaaaccgg<br>ctgcgccgggcttgattttaattctgctgtagagtcgcaaccgggtatcaaagacgcacgtcttttgg<br>cctcggttttccagacgctgcgcgcatattaa |
| TrpC<br>SEQ ID<br>NO: 129 | MQTVLAKIVADKAIWVETRKEQQPLASFQNEVQPSTRHFYDA<br>LQGARTAFILECKKASPSKGVIRDDFDPARIAAIYKHYASAISV<br>LTDEKYFQGSFDFLPIVSQIAPQPILCKDFIIDPYQIYLARYYQA<br>DACLLMLSVLDDEQYRQLAAVAHSLEMGVLTEVSNEEELER<br>AIALGAKVVGINNRDLRDLSIDLNRTRELAPKLGHNVTVISES<br>GINTYAQVRELSHFANGFLIGSALMAHDDLNAAVRRVLLGEN<br>KVCGLTRGQDAKAAYDAGAIYGGLIFVATSPRCVNVEQAQE<br>VMAAAPLQYVGVFRNHDIADVADKAKVLSLAAVQLHGNED<br>QLYIDNLREALPAHVAIWKALSVGETLPARDFQHIDKYVFDN<br>GQGGSGQRFDWSLLNGQSLGNVLLAGGLGADNCVEAAQTG<br>CAGLDFNSAVESQPGIKDARLLASVFQTLRAY |
| trpB<br>SEQ ID<br>NO: 130 | atgacaacattacttaaccctattttggtgagtttggcggcatgtacgtgccacaaatcctgatgcct<br>gctctgcgccagctggaagaagcttttgtcagcgcgcaaaaagatcctgaatttcaggctcagttca<br>acgacctgctgaaaaactatgccgggcgtccaaccgcgctgaccaaatgccagaacattacagc<br>cgggacgaacaccacgctgtatctgaagcgcgaagatttgctgcacggcggcgcgcataaaact<br>aaccaggtgctcggtcaggcttttactggcgaagcggatgggtaaaactgaaattattgccgaaacc<br>ggtgccggtcagcatggcgtggcgtcggcccttgccagcgccctgctcggcctgaaatgccgaa<br>tttatatgggtgccaaagacgttgaacgccagtcgcccaacgttttccggatgcgcttaatgggtgc<br>ggaagtgatcccggtacatagcggttccgcgaccctgaaagatgcctgtaatgaggcgctacgcg<br>actggtccggcagttatgaaaccgcgcactatatgctgggtaccgcagctggcccgcatccttacc<br>cgaccattgtgcgtgagtttcagcggatgattggcgaagaaacgaaagcgcagattctggaaaga<br>gaaggtcgcctgccggatgccgttatcgcctgtgttggcggtggttcgaatgccatcggtatgtttg<br>cagatttcatcaacgaaaccgacgtcggcctgattggtgtggagcctggcggccacggtatcgaa<br>actggcgagcacggcgcaccgttaaaacatggtcgcgtgggcatctatttcggtatgaaagcgcc<br>gatgatgcaaaccgaagcgggcaaattgaagagtcttactccatttctgccgggctggatttccc<br>gtccgtcggcccgcaacatgcgtatctcaacagcactggacgcgctgattacgtgtctattaccga<br>cgatgaagcctggaagcctttaaaacgctttgcctgcatgaagggatcatcccggcgctggaatc<br>ctcccacgccctggcccatgcgctgaaaatgatgcgcgaaaatccggaaaaagagcagctactg<br>gtggttaacctttccggtcgcggcgataaagacatcttcaccgttcacgatattttgaaagcacgag<br>gggaaatctga |
| TrpB<br>SEQ ID<br>NO: 131 | MTTLLNPYFGEFGGMYVPQILMPALRQLEEAFVSAQKDPEFQ<br>AQFNDLLKNYAGRPTALTKCQNITAGTNTTLYLKREDLLHGG<br>AHKTNQVLGQALLAKRMGKTEIIAETGAGQHGVASALASAL<br>LGLKCRIYMGAKDVERQSPNVFRMRLMGAEVIPVHSGSATLK<br>DACNEALRDWSGSYETAHYMLGTAAGPHPYPTIVREFQRMIG<br>EETKAQILEREGRLPDAVIACVGGGSNAIGMFADFINETDVGLI<br>GVEPGGHGIETGEHGAPLKHGRVGIYFGMKAPMMQTEDGQIE<br>ESYSISAGLDFPSVGPQHAYLNSTGRADYVSITDDEALEAFKT<br>LCLHEGIIPALESSHALAHALKMMRENPEKEQLLVVNLSGRG<br>DKDIFTVHDILKARGEI |
| trpA<br>SEQ ID<br>NO: 132 | atggaacgctacgaatctctgtttgcccagttgaaggagcgcaaagaaggcgcattcgttcctttcg<br>tcaccctcggtgatccgggcattgagcagtcgttgaaaattatcgatacgctaattgaagccggtgc<br>tgacgcgctggagttaggcatccccttctccgacccactggcggatggcccgacgattcaaaacg<br>ccacactgcgtgcttttgcggcgggagtaaccccggcgcagtgctttgagatgctggcactcattc<br>gccagaagcacccgaccattcccatcggccttttgatgtatgccaacctggtgtttaacaaaggcat<br>tgatgagttttatgccgagtgcgagaaagtcggcgtcgattcggtgctggttgccgatgtgcccgtg<br>gaagagtccgcgcccttccgccaggccgcgttgcgtcataatgtcgcacctatctttatttgcccgc<br>cgaatgccgacgatgatttgctgcgccagatagcctcttacggtcgtggttacacctatttgctgtcg<br>cgagcgggcgtgaccggcgcagaaaaccgcgccgcgttacccctcaatcatctggttgcgaagc<br>tgaaagagtacaacgctgcgcctccattgcagggatttggtatttccgcccgggatcaggtaaaag<br>ccgcgattgatgcaggagctgcgggcgcgatttctggttcggccatcgttaaaatcatcgagcaac<br>atattaatgagccagagaaaatgctggcggcactgaaagcttttgtacaaccgatgaaagcggcg<br>acgcgcagttaa |
| TrpA<br>SEQ ID<br>NO: 133 | MERYESLFAQLKERKEGAFVPFVTLGDPGIEQSLKIIDTLIEAG<br>ADALELGIPFSDPLADGPTIQNATLRAFAAGVTPAQCFEMLAL<br>IRQKHPTIPIGLLMYANLVFNKGIDEFYAECEKVGVDSVLVAD<br>VPVEESAPFRQAALRHNVAPIFICPPNADDDLLRQIASYGRGY<br>TYLLSRAGVTGAENRAALPLNHLVAKLKEYNAAPPLQGFGIS<br>APDQVKAAIDAGAEGAISGSAIVKIIEQHINEPEKMLAALKAF<br>VQPMKAATRS |

In some embodiments, the genetically engineered bacteria comprise one or more nucleic acid sequence of Table 14 or a functional fragment thereof. In some embodiments, the genetically engineered bacteria comprise a nucleic acid sequence that, but for the redundancy of the genetic code, encodes the same polypeptide as one or more nucleic acid sequence of Table 14 or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of one or more nucleic acid sequence of Table 14 or a functional fragment thereof, or a nucleic acid sequence that, but for the redundancy of the genetic code, encodes the same polypeptide as one or more nucleic acid sequence of Table 14 or a functional fragment thereof.

In one embodiment, one or more polypeptides and/polynucleotides encoded and expressed by the genetically engineered bacteria have at least about 80% identity with one or more of SEQ ID NO: 121 through SEQ ID NO: 133. In one embodiment, one or more polypeptides and/polynucleotides encoded and expressed by the genetically engineered bacteria have at least about 85% identity with one or more of SEQ ID NO: 121 through SEQ ID NO: 133. In one embodiment, one or more polypeptides and/polynucleotides encoded and expressed by the genetically engineered bacteria have at least about 90% identity with one or more of SEQ ID NO: 121 through SEQ ID NO: 133. In one embodiment, one or more polypeptides and/polynucleotides encoded and expressed by the genetically engineered bacteria have at least about 95% identity with one or more of SEQ ID NO: 121 through SEQ ID NO: 133. In one embodiment, one or more polypeptides and/polynucleotides encoded and expressed by the genetically engineered bacteria have at least about 96%, 97%, 98%, or 99% identity with one or more of SEQ ID NO: 121 through SEQ ID NO: 133. Accordingly, in one embodiment, one or more polypeptides and/or polynucleotides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 121 through SEQ ID NO: 133. In another embodiment, one or more polynucleotides and/or polypeptides encoded and expressed by the genetically engineered bacteria comprise the sequence of one or more of SEQ ID NO: 121 through SEQ ID NO: 133. In another embodiment, one or more polynucleotides and/or polypeptides encoded and expressed by the genetically engineered bacteria comprise the sequence of one or more of SEQ ID NO: 121 through SEQ ID NO: 133.

Table 15 lists exemplary genes encoding kynureninase which are encoded by the genetically engineered bacteria of the disclosure in certain embodiments.

TABLE 15

| Kynureninase protein sequences | | |
|---|---|---|
| Description | ID | Sequence |
| *Pseudomonas* kynureninase SEQ ID NO: 134 | P83788 | MTTRNDCLALDAQDSLAPLRQQFALPEGVIYLD GNSLGARPVAALARAQAVIAEEWGNGLIRSWNS AGWRDLSERLGNRLATLIGARDGEVVVTDTTSIN LFKVLSAALRVQATRSPERRVIVTETSNFPTDLYI AEGLADMLQQGYTLRLVDSPEELPQAIDQDTAV VMLTHVNYKTGYMHDMQALTALSHECGALAIW DLAHSAGAVPVDLHQAGADYAIGCTYKYLNGG PGSQAFVWVSPQLCDLVPQPLSGWFGHSRQFAM EPRYEPSNGIARYLCGTQPITSLAMVECGLDVFA QTDMASLRRKSLALTDLFIELVEQRCAAHELTLV TPREHAKRGSHVSFEHPEGYAVIQALIDRGVIGD YREPRIMRFGFTPLYTTFTEVWDAVQILGEILDRK TWAQAQFQVRHSVT\* |
| Human SEQ ID NO: 135 | Q16719 | MEPSSLELPADTVQRIAAELKCHPTDERVALHLD EEDKLRHFRECFYIPKIQDLPPVDLSLVNKDENAI YFLGNSLGLQPKMVKTYLEEELDKWAKIAAYGH EVGKRPWITGDESIVGLMKDIVGANEKEIALMN ALTVNLHLLMLSFFKPTPKRYKILLEAKAFPSDH YAIESQLQLHGLNIEESMRMIKPREGEETLRIEDIL EVIEKEGDSIAVILFSGVHFYTGQHFNIPAITKAG QAKGCYVGFDLAHAVGNVELYLHDWGVDFAC WCSYKYLNAGAGGIAGAFIHEKHAHTIKPALVG WFGHELSTRFKMDNKLQLIPGVCGFRISNPPILLV CSLHASLEIFKQATMKALRKKSVLLTGYLEYLIK HNYGKDKAATKKPVVNIITPSHVEERGCQLTITF SVPNKDVFQELEKRGVVCDKRNPNGIRVAPVPL YNSFHDVYKFTNLLTSILDSAETKN\* |
| *Shewanella* SEQ ID NO: 136 | Q8E973 | MLLNVKQDFCLAGPGYLLNHSVGRPLKSTEQAL KQAFFAPWQESGREPWGQWLGVIDNFTAALASL FNGQPQDFCPQVNLSSALTKIVMSLDRLTRDLTR NGGAVVLMSEIDFPSMGFALKKALPASCELRFIP KSLDVTDPNVWDAHICDDVDLVFVSHAYSNTGQ QAPLAQIISLARERGCLSLVDVAQSAGILPLDLAK LQPDFMIGSSVKWLCSGPGAAYLWVNPAILPEC QPQDVGWFSHENPFEFDIHDFRYHPTALRFWGG |

TABLE 15-continued

Kynureninase protein sequences

| Description | ID | Sequence |
|---|---|---|
| | | TPSIAPYAIAAHSIEYFANIGSQVMREHNLQLMEP VVQALDNELVSPQEVDKRSGTIILQFGERQPQILA ALAAANISVDTRSLGIRVSPHIYNDEADIARLLGV IKANR* |

*designates the position of the stop codon

Table 16 lists exemplary codon-optimized kynureninase cassette sequences.

TABLE 16

Selected codon-optimized kynureninase cassette sequences

| Kynureninase protein sequences | Kynureninase protein sequences |
|---|---|
| Ptet-kynU(Pseudomonas) SEQ ID NO: 137 | atctaatctagacatcattaattcctaattttgttgacactctatcattgatagagtta ttttaccactccctatcagtgatagagaaagtgaattatataaaagtgggaggtgcc cgaatgacgacccgaaatgattgcctagcgttggatgcacaggacagtctggctccgct gcgccaacaatttgcgctgccggagggtgtgatatacctggatggcaattcgctgggcg cacgtccggtagctgcgctggctcgcgcgcaggctgtgatcgcagaagaatggggca acggggttgatccgttcatggaactctgcgggctggcgtgatctgtctgaacgcctgggta atcgcctggctaccctgattggtgcgcgcgatggggaagtagttgttactgataccacct cgattaatctgtttaaagtgctgtcagcggcgctgcgcgtgcaagctacccgtagcccgg agcgccgtgttatcgtgactgagacctcgaatttcccgaccgacctgtatattgcggaag ggttggcggatatgctgcaacaaggttacactctgcgtttggtggattcaccggaagagc tgccacaggctatagatcaggacaccgcggtggtgatgctgacgcacgtaaattataaa accggttatatgcacgacatgcaggctctgaccgcgttgagccacgagtgtggggctct ggcgatttgggatctggcgcactctgctggcgctgtgccggtggacctgcaccaagcg ggcgcggactatgcgattggctgcacgtacaaatacctgaatggcggcccgggttcgc aagcgtttgtttgggtttcgccgcaactgtgcgacctggtaccgcagccgctgtctggttg gttcggccatagtcgccaattcgcgatggagccgcgctacgaaccttctaacggcattg ctcgctatctgtgcggcactcagcctattactagcttggctatggtggagtgcggccttgga tgtgtttgcgcagacggatatggcttcgctgcgccgtaaaagtctggcgctgactgatct gttcatcgagctggttgaacaacgctgcgctgcacacgaactgaccctggttactccacg tgaacacgcgaaacgcggctctcacgtgtcttttgaacaccccgagggttacgctgttatt caagctctgattgatcgtggcgtgatcggcgattaccgtgagccacgtattatgcgttttcg gtttcactcctctgtatactacttttacggaagtttgggatgcagtacaaatcctgggcgaa atcctggatcgtaagacttgggcgcaggctcagtttcaggtgcgccactctgttacttaaa *aataaaacgaaaggctcagtcgaaagactgggcctttcgttttatctgttg* |
| Ptet-kynU(Human) SEQ ID NO: 138 | atctaatctagacatcattaattcctaattttgttgacactctatcattgatagagtta ttttaccactccctatcagtgatagagaaagtgaatatcaagacacgaggaggtaa gattatggagccttcatctttagaactgccagcggacacggtgcagcgcatcgcggcgg aactgaagtgccatccgactgatgagcgtgtggcgctgcatctggacggaagaagataa actgcgccactttcgtgaatgttttttatattcctaaaattcaagacttgccgccggtagatttg agtctcgttaacaaagatgaaaacgcgatctactttctgggcaactctctgggtctgcaac caaaaatggttaaaacgtacctggaggaagaactggataaatgggcaaaaatcgcggc ttatggtcacgaagtggggcaagcgtccttggattactggcgacgagtctattgtgggtttg atgaaagatattgtgggcgcgaatgaaaaggaaattgcactgatgaatgctctgaccgtt aatctgcacctgctgatgctgtcttttttaaaccgaccccgaaacgctacaaaatactgct ggaagcgaaagcgtttccgtcggatcactatgctatagaaagtcaactgcagttgcatgg tctgaatatcgaggaatctatgcgcatgattaaaccgcgtgagggtgaagaaacgctgc gtattgaagacattctggaagttattgaaaaagaaggtgattctatcgcagttatactgtttt ctggcgtgcacttttatacaggtcagcacttcaatatcccggcaatcactaaagcggggc aggcaaaaggctgctatgttggttttgacctggcgcatgcagtggggaatgttgaactgt atctgcacgattggggcgttgatttcgcgtgttggtgtagctacaaatatctgaacgctgg cgcgggtggcattgctggcgcttttattcacgaaaaacacgcgcacaccattaaaccgg ctctggttggctggttcggtcatgagctgagtactcgctttaaaatggataacaaactgca attgattccgggtgtttgcggcttccgtatcagcaatccgccgattctgctggtttgcagcc tgcacgctagtctggaaatctttaagcaggcgactatgaaagcgctgcgcaaaaaatctg tgctgctgaccggctatctggagtatctgatcaaacacaattatggcaaagataaagctg caactaaaaaaccggtagtgaacattatcaccccctcacacgtggaggagcgcggttgt cagctgactattactttcagtgtacctaataaagatgtgttccaggaactggaaaaacgcg gcgttgtttgtgataaacgtaacccgaatggtattcgcgtggcctcctgtgccgctgtacaat tcattccacgatgtttataaattcaccaacctgctgacttctattctcgacagtgctgagact *aaaaattaaaaataaaacgaaaggctcagtcgaaagactgggcctttcgttttatctgtt* |
| ptet-kynU(Shewanella) SEQ ID NO: 139 | atctaatctagacatcattaattcctaattttgttgacactctatcattgatagagtta ttttaccactccctatcagtgatagagaaagtgaatggttcaccaccacaaggagg gattatgctgctgaatgtaaaacaggacttttgcctggcaggccccgggctacctgctgaa tcactcggttggccgtccgctgaaatcaactgagcaagcgctgaaacaagcatttttttgct ccgtggcaagagagcggtcgtgaaccgtggggccagtggctgggtgttattgataattt |

TABLE 16-continued

Selected codon-optimized kynureninase cassette sequences

| Kynureninase protein sequences | Kynureninase protein sequences |
|---|---|
| | cactgctgcgctggcatctctgtttaatggtcaaccgcaggattttttgtccgcaggttaacc tgagcagcgcgctgactaaaattgtgatgtcactggatcgtctgactcgcgatctgaccc gcaatggcggtgctgttgtgctgatgtctgaaatcgatttcccatctatgggcttcgcgttg aaaaaagcgctgccagcgagctgcgaactgcgttttatcccgaaaagtctggacgtgac tgatccgaacgtatgggatgcacacatctgtgatgatgtagacctggtttttgtgtctcacg cctatagtaatacgggccaacaggctccgctggcgcaaatcatctctctggcgcgtgaa cgtggctgcctgtcactggtggatgtagcgcaatcagcggggattttgccgctggatctg gcgaaactgcaaccggacttcatgatcggcagttcggttaaatggctgtgctcgggccct ggtgcggcatatctgtgggttaatccggcgattctgccggaatgtcagccgcaggatgt gggctggttttcacatgagaatccctttgaattcgacatccacgatttccgctaccacccg actgcactgcgcttttggggtggtacgccgtcgatcgcgccttatgcgatcgcggcgca ctcgatcgaatattttgccaatatcggctcgcaagtgatgcgtgaacacaacctgcaactg atggaaccggtggttcaggcgctggacaatgaactggtgagcccgcaggaagtggata aacgctcaggcactattattctgcaattcggtgaacgtcaaccgcaaattctggcggctct ggctgcggcgaacatttcggtggacactcgttctttggggattcgtgttagtccgcacattt ataatgatgaggcggacattgcgcgcctgctgggtgtgatcaaagcaaatcgctaaaaa taaaacgaaaggctcagtcgaaagactgggcctttcgttttatctgttg |

The ptet-promoter is in bold, designed Ribosome binding site is underlined, codon-optimized protein coding sequence is in plain text, and the terminator is in italics.

In one embodiment, one or more polypeptides and/polynucleotides encoded and expressed by the genetically engineered bacteria have at least about 80% identity with one or more of SEQ ID NO: 121 through SEQ ID NO: 133. In one embodiment, one or more polypeptides and/polynucleotides encoded and expressed by the genetically engineered bacteria have at least about 85% identity with one or more of SEQ ID NO: 121 through SEQ ID NO: 133. In one embodiment, one or more polypeptides and/polynucleotides encoded and expressed by the genetically engineered bacteria have at least about 90% identity with one or more of SEQ ID NO: 121 through SEQ ID NO: 133. In one embodiment, one or more polypeptides and/polynucleotides encoded and expressed by the genetically engineered bacteria have at least about 95% identity with one or more of SEQ ID NO: 121 through SEQ ID NO: 133. In one embodiment, one or more polypeptides and/polynucleotides encoded and expressed by the genetically engineered bacteria have at least about 96%, 97%, 98%, or 99% identity with one or more of SEQ ID NO: 121 through SEQ ID NO: 133. Accordingly, in one embodiment, one or more polypeptides and/or polynucleotides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 121 through SEQ ID NO: 133. In another embodiment, one or more polynucleotides and/or polypeptides encoded and expressed by the genetically engineered bacteria comprise the sequence of one or more of SEQ ID NO: 121 through SEQ ID NO: 133. In another embodiment, one or more polynucleotides and/or polypeptides encoded and expressed by the genetically engineered bacteria comprise the sequence of one or more of SEQ ID NO: 121 through SEQ ID NO: 133.

In some embodiments, the genetically engineered bacteria comprise one or more nucleic acid sequence of Table 16 or a functional fragment thereof. In some embodiments, the genetically engineered bacteria comprise a nucleic acid sequence that, but for the redundancy of the genetic code, encodes the same polypeptide as one or more nucleic acid sequence of Table 16 or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of one or more nucleic acid sequence of Table 16 or a functional fragment thereof, or a nucleic acid sequence that, but for the redundancy of the genetic code, encodes the same polypeptide as one or more nucleic acid sequence of Table 16 or a functional fragment thereof.

In one embodiment, one or more polynucleotides encoded and expressed by the genetically engineered bacteria have at least about 80% identity with one or more of SEQ ID NO: 137 through SEQ ID NO: 139. In one embodiment, one or more polynucleotides encoded and expressed by the genetically engineered bacteria have at least about 85% identity with one or more of SEQ ID NO: 137 through SEQ ID NO: 139. In one embodiment, one or more polynucleotides encoded and expressed by the genetically engineered bacteria have at least about 90% identity with one or more of SEQ ID NO: 137 through SEQ ID NO: 139. In one embodiment, one or more polynucleotides encoded and expressed by the genetically engineered bacteria have at least about 95% identity with one or more of SEQ ID NO: 137 through SEQ ID NO: 139. In one embodiment, one or more polynucleotides encoded and expressed by the genetically engineered bacteria have at least about 96%, 97%, 98%, or 99% identity with one or more of SEQ ID NO: 137 through SEQ ID NO: 139. Accordingly, in one embodiment, one or more polynucleotides expressed by the genetically engineered bacteria have at least about 80%, 81%, 82%, 83%, 84%, 85%, 86%, 87%, 88%, 89%, 90%, 91%, 92%, 93%, 94%, 95%, 96%, 97%, 98%, or 99% identity with one or more of SEQ ID NO: 137 through SEQ ID NO: 139. In another embodiment, one or more polynucleotides encoded and expressed by the genetically engineered bacteria comprise the sequence of one or more of SEQ ID NO: 137 through SEQ ID NO: 139. In another embodiment, one or more polynucleotides encoded and expressed by the genetically engineered bacteria comprise the sequence of one or more of SEQ ID NO: 137 through SEQ ID NO: 139.

The genetically engineered bacteria may comprise any suitable gene for producing kynureninase. In some embodiments, the gene for producing kynureninase is modified and/or mutated, e.g., to enhance stability, increase kynureninase production. In some embodiments, the engineered bacteria also have enhanced uptake or import of tryptophan, e.g., comprise a transporter or other mechanism for increasing the uptake of tryptophan into the bacterial cell, as discussed in detail above. In some embodiments, the genetically engineered bacteria are capable of producing kynureninase under inducing conditions, e.g., under a condition(s) associated with inflammation. In some embodiments, the genetically engineered bacteria are capable of producing kynureninase in low-oxygen conditions, in the presence of certain molecules or metabolites, in the presence of molecules or metabolites associated with liver damage, metabolic disease, inflammation or an inflammatory response, or in the presence of some other metabolite that may or may not be present in the gut, such as arabinose.

The genetically engineered bacteria may comprise any suitable gene for producing kynureninase. In some embodiments, the gene for producing kynureninase is modified and/or mutated, e.g., to enhance stability, increase kynureninase production. In some embodiments, the engineered bacteria also have enhanced uptake or import of tryptophan, e.g., comprise a transporter or other mechanism for increasing the uptake of tryptophan into the bacterial cell, as discussed in detail above. In some embodiments, the genetically engineered bacteria are capable of producing kynureninase under inducing conditions, e.g., under a condition(s) associated with inflammation. In some embodiments, the genetically engineered bacteria are capable of producing kynureninase in low-oxygen conditions. In some embodiments, the genetically engineered bacteria are capable of producing kynureninase in the presence of certain molecules or metabolites, in the presence of molecules or metabolites associated with liver damage, metabolic disease, inflammation or an inflammatory response, or in the presence of some other metabolite that may or may not be present in the gut, such as arabinose.

Producing Kynurenic Acid

In some embodiments, the genetically engineered bacteria are capable of producing kynurenic acid. Kynurenic acid is produced from the irreversible transamination of kynurenine in a reaction catalyzed by the enzyme kynurenine-oxoglutarate transaminase. Kynurenic acid acts as an antagonist of ionotropic glutamate receptors (Turski et al., 2013). While glutamate is known to be a major excitatory neurotransmitter in the central nervous system, there is now evidence to suggest an additional role for glutamate in the peripheral nervous system. For example, the activation of NMDA glutamate receptors in the major nerve supply to the GI tract (i.e., the myenteric plexus) leads to an increase in gut motility (Forrest et al., 2003), but rats treated with kynurenic acid exhibit decreased gut motility and inflammation in the early phase of acute colitis (Varga et al., 2010). Thus, the elevated levels of kynurenic acid reported in IBD patients may represent a compensatory response to the increased activation of enteric neurons (Forrest et al., 2003). The genetically engineered bacteria may comprise any suitable gene or genes for producing kynurenic acid. In some embodiments, the engineered bacteria comprise gene sequence(s) encoding one or more kynurenine-oxoglutarate transaminases (also referred to as kynurenine aminotransferases (e.g., KAT I, II, III)).

In some embodiments, the gene or genes for producing kynurenic acid is modified and/or mutated, e.g., to enhance stability, increase kynurenic acid production under inducing conditions. In some embodiments, the genetically engineered bacteria are capable of producing kynurenic acid under inducing conditions, e.g., under a condition(s) associated with inflammation. In some embodiments, the genetically engineered bacteria are capable of producing kynurenic acid in low-oxygen conditions, in the presence of certain molecules or metabolites, in the presence of molecules or metabolites associated with liver damage, metabolic disease, inflammation or an inflammatory response, or in the presence of some other metabolite that may or may not be present in the gut, such as arabinose.

In some embodiments, the genetically engineered bacteria comprise one or more gene(s) or gene cassette(s) for the consumption of tryptophan and production of kynurenic acid, which are bacterially derived. In some embodiments, the enzymes for producing kynureic acid are derived from one or more of *Pseudomonas, Xanthomonas, Burkholderia, Stenotrophomonas, Shewanella*, and *Bacillus*, and/or members of the families Rhodobacteraceae, Micrococcaceae, and Halomonadaceae, In some embodiments the enzymes are derived from the species listed in table S7 of Vujkovic-Cvijin et al. (Dysbiosis of the gut microbiota is associated with HIV diseaseprogression and tryptophan catabolism Sci Transl Med. 2013 Jul. 10; 5(193): 193ra91), the contents of which is herein incorporated by reference in its entirety.

In some embodiments, the genetically engineered bacteria comprise gene sequence(s) encoding one or more tryptophan transporters and gene sequence(s) encoding kynureninase. In some embodiments, the genetically engineered bacteria comprise gene sequence(s) encoding one or more tryptophan transporters and gene sequence(s) encoding one or more kynurenine-oxoglutarate transaminases (kynurenine aminotransferases). In some embodiments, the genetically engineered bacteria comprise gene sequence(s) encoding one or more tryptophan transporters, gene sequence(s) encoding kynureninase, and gene sequence(s) encoding one or more kynurenine-oxoglutarate transaminases (kynurenine aminotransferases). In some embodiments, the genetically engineered bacteria comprise gene sequence(s) encoding kynureninase and gene sequence(s) encoding one or more kynurenine aminotransferases.

In some embodiments, the one or more genes for producing kynurenic acid are modified and/or mutated, e.g., to enhance stability, increase kynurenic acid production under inducing conditions. In some embodiments, the engineered bacteria have enhanced uptake or import of tryptophan, e.g., comprise a transporter or other mechanism for increasing the uptake of tryptophan into the bacterial cell. In some embodiments, the genetically engineered bacteria are capable of producing kynurenic acid under inducing conditions, e.g., under a condition(s) associated with inflammation. In some embodiments, the genetically engineered bacteria are capable of producing kynurenic acid in low-oxygen conditions, in the presence of certain molecules or metabolites, in the presence of molecules or metabolites associated with liver damage, metabolic disease, inflammation or an inflammatory response, or in the presence of some other metabolite that may or may not be present in the gut, such as arabinose.

In some embodiments, the genetically engineered bacteria are capable of expressing any one or more of the described circuits in low-oxygen conditions, in the presence of disease or tissue specific molecules or metabolites, in the presence of molecules or metabolites associated with inflammation or an inflammatory response or immune suppression, liver damage, metabolic disease, or in the presence of some other metabolite that may or may not be present in the gut, such as arabinose. In some embodiments, any one or more of the described circuits are present on one or more plasmids (e.g., high copy or low copy) or are integrated into one or more sites in the bacterial chromosome. Also, in some embodiments, the genetically engineered bacteria are further capable of expressing any one or more of the described circuits and further comprise one or more of the following:

(1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, and (6) combinations of one or more of such additional circuits.

Increasing Indole Tryptophan Metabolites

Figure 31:
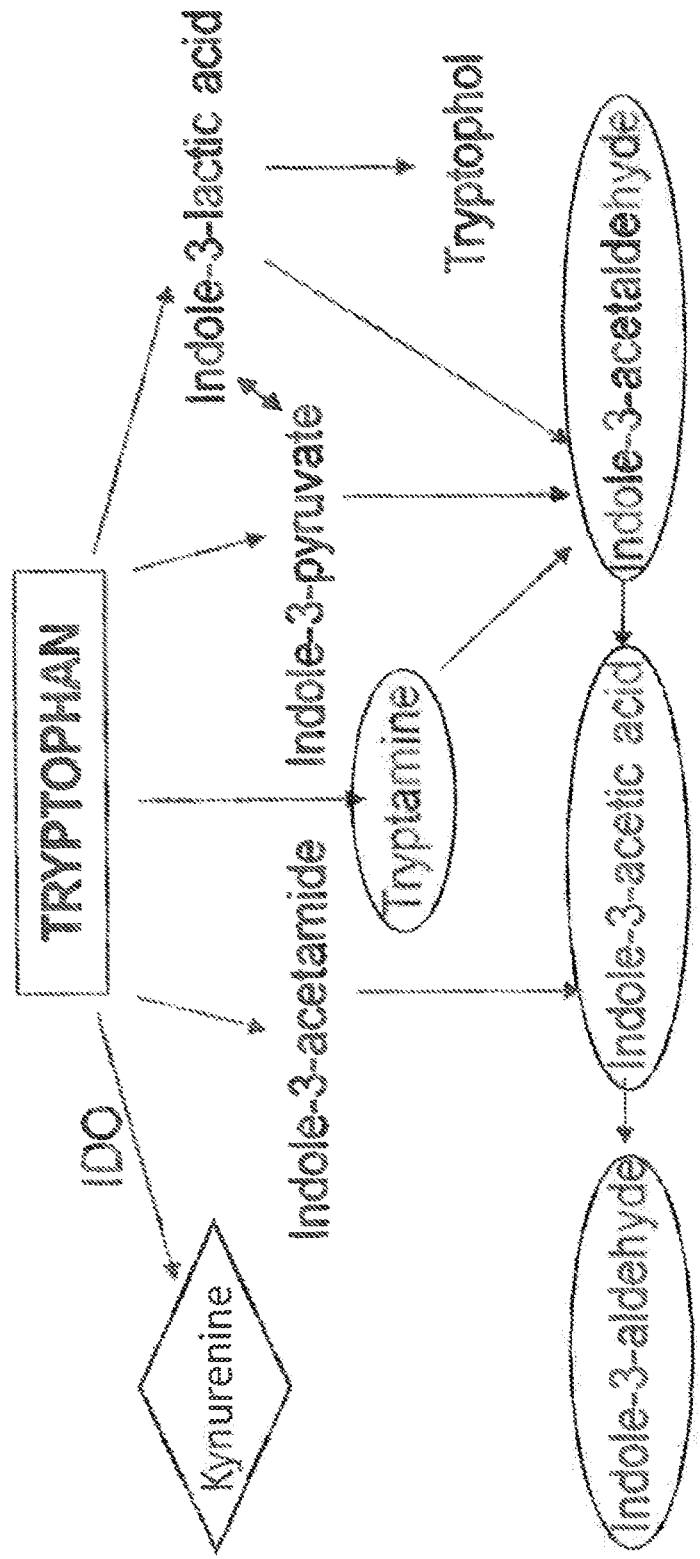
FIG. 31 depicts a schematic of the trypophan metabolic pathway. Host and microbiota metabolites with AhR agonistic activity are in diamond and circled, respectively (see, e.g., Lamas et al., CARD9 impacts colitis by altering gut microbiota metabolism of tryptophan into aryl hydrocarbon receptor ligands; Nature Medicine 22, 598-605 (2016). In certain embodiments of the disclosure, the genetically engineered bacteria comprise gene cassettes comprising one or more of the bacterial tryptophan metabolism enzymes which catalyze the reactions shown in FIG. 31. In certain embodiments, the genetically engineered bacteria comprise one or more gene cassettes which produce one or more of the metabolites depicted in FIG. 31, including but not limited to, kynurenine, indole-3-aldehyde, indole-3-acetic acid, and/or indole-3 acetaldehyde. In certain embodiments, the one or more cassettes are on a plasmid; in other embodiments, the cassettes are integrated into the genome. In certain embodiments the one or more cassettes are under the control of inducible promoters which are induced under low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose.

The monoamine alkaloid, tryptamine, is derived from the direct decarboxylation of tryptophan. Tryptophan is converted to indole-3-acetic acid (IAA) via the enzymes tryptophan monooxygenase (IaaM) and indole-3-acetamide hydrolase (IaaH), which constitute the indole-3-acetamide (IAM) pathway, see eg., FIG. 31 and FIG. 32.

TABLE 17

Sequences for Tryptophan to tryptamine conversion

| Description | Sequence |
| --- | --- |
| Tryptophan Decarboxylase (EC 4.1.1.28) Chain A, *Ruminococcus Gnavus* Tryptophan Decarboxylase Rumgna_01526 (alpha-fmt) SEQ ID NO: 140 | MSQVIKKKRNTFMIGTEYILNSTQLEEAIKSFV HDFCAEKHEIHDQPVVVEAKEHQEDKIKQIKIP EKGRPVNEVVSEMMNEVYRYRGDANHPRFFS FVPGPASSVSWLGDIMTSAYNIHAGGSKLAPM VNCIEQEVLKWLAKQVGFTENPGGVFVSGGS MANITALTAARDNKLTDINLHLGTAYISDQTH SSVAKGLRIIGITDSRIRRIPTNSHFQMDTTKLE EAIETDKKSGYIPFVVIGTAGTTNTGSIDPLTEIS ALCKKHDMWFHIDGAYGASVLLSPKYKSLLT GTGLADSISWDAHKWLFQTYGCAMVLVKDIR NLFHSFHVNPEYLKDLENDIDNVNTWDIGMEL TRPARGLKLWLTLQVLGSDLIGSAIEHGFQLA VWAEEALNPKKDWEIVSPAQMAMINFRYAPK DLTKEEQDILNEKISHRILESGYAAIFTTVLNGK TVLRICAIHPEATQEDMQHTIDLLDQYGREIYT EMKKa |
| Tryptophan Decarboxylase (EC 4.1.1.28) Chain A, *Ruminococcus Gnavus* Tryptophan Decarboxylase Rumgna_01526 (alpha-fmt); codon optimized for the expression in *E. coli* SEQ ID NO: 141 | ATGAGTCAAGTGATTAAGAAGAAACGTAAC ACCTTTATGATCGGAACGGAGTACATTCTTA ACAGTACACAATTGGAGGAAGCGATTAAAT CATTCGTACATGATTTCTGCGCAGAGAAGCA TGAGATCCATGATCAACCTGTGGTAGTAGAA GCTAAAGAACATCAGGAGGACAAAATCAAA CAAATCAAAATCCCGGAAAAGGGACGTCCT GTAAATGAAGTCGTTTCTGAGATGATGAATG AAGTGTATCGCTACCGCGGAGACGCCAACC ATCCTCGCTTTTTTTCTTTTGTGCCCGGACCT GCAAGCAGTGTGTCGTGGTTGGGGGATATTA TGACGTCCGCCTACAATATTCATGCTGGAGG CTCAAAGCTGGCACCGATGGTTAACTGCATT GAGCAGGAAGTTCTGAAGTGGTTAGCAAAG CAAGTGGGGTTCACAGAAAATCCAGGTGGC GTATTTGTGTCGGGCGGTTCAATGGCGAATA TTACGGCACTTACTGCGGCTCGTGACAATAA ACTGACCGACATTAACCTTCATTTGGGAACT GCTTATATTAGTGACCAGACTCATAGTTCAG TTGCGAAAGGATTACGCATTATTGGAATCAC TGACAGTCGCATCCGTCGCATTCCCACTAAC TCCCACTTCCAGATGGATACCACCAAGCTGG AGGAAGCCATCGAGACCGACAAGAAGTCTG GCTACATTCCGTTCGTCGTTATCGGAACAGC AGGTACCACCAACACTGGTTCGATTGACCCC CTGACAGAAATCTCTGCGTTATGTAAGAAGC ATGACATGTGGTTTCATATCGACGGAGCGTA TGGAGCTAGTGTTCTGCTGTCACCTAAGTAC AAGAGCCTTCTTACCGGAACCGGCTTGGCTG ACAGTATTTCGTGGGATGCTCATAAATGGTT GTTCCAAACGTACGGCTGTGCAATGGTACTT GTCAAAGATATCCGTAATTTATTCCACTCTTT TCATGTGAATCCCGAGTATCTTAAGGATCTG GAAAACGACATCGATAACGTTAATACATGG GACATCGGCATGGAGCTGACGCGCCCTGCA CGCGGTCTTAAATTGTGGCTTACTTTACAGG TCCTTGGATCTGACTTGATTGGGAGTGCCAT TGAACACGGTTTCCAGCTGGCAGTTTGGGCT GAGGAAGCATTGAATCCAAAGAAAGACTGG GAGATCGTTTCTCCAGCTCAGATGGCTATGA TTAATTTCCGTTATGCCCCTAAGGATTTAAC CAAAGAGGAACAGGATATTCTGAATGAAAA GATCTCCCACCGCATTTTAGAGCGGATAC GCTGCAATTTTCACTACTGTATTAAACGGCA AGACCGTTTTACGCATCTGTGCAATTCACCC |

TABLE 17-continued

Sequences for Tryptophan to tryptamine conversion

| Description | Sequence |
|---|---|
| | GGAGGCAACTCAAGAGGATATGCAACACAC<br>AATCGACTTATTAGACCAATACGGTCGTGAA<br>ATCTATACCGAGATGAAGAAAGCG |

In some embodiments, the genetically engineered bacteria comprise one or more nucleic acid sequence of Table 17 or a functional fragment thereof. In some embodiments, the genetically engineered bacteria comprise a nucleic acid sequence that, but for the redundancy of the genetic code, encodes the same polypeptide as one or more nucleic acid sequence of Table 17 or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of one or more nucleic acid sequence of Table 17 or a functional fragment thereof, or a nucleic acid sequence that, but for the redundancy of the genetic code, encodes the same polypeptide as one or more nucleic acid sequence of Table 17 or a functional fragment thereof.

In one embodiment, the Tryptophan Decarboxylase gene has at least about 80% identity with the entire sequence of SEQ ID NO: 140 or SEQ ID NO. 141. In another embodiment, the Tryptophan Decarboxylase gene has at least about 85% identity with the entire sequence of SEQ ID NO: 140 or SEQ ID NO. 141. In one embodiment, the Tryptophan Decarboxylase gene has at least about 90% identity with the entire sequence of SEQ ID NO: 140 or SEQ ID NO. 141. In one embodiment, the Tryptophan Decarboxylase gene has at least about 95% identity with the entire sequence of SEQ ID NO: 140 or SEQ ID NO. 141. In another embodiment, the Tryptophan Decarboxylase gene has at least about 96%, 97%, 98%, or 99% identity with the entire sequence of SEQ ID NO: 140 or SEQ ID NO. 141. Accordingly, in one embodiment, the Tryptophan Decarboxylase gene has at least about 80%, 81%, 82%, 83%, 84%, 85%, 86%, 87%, 88%, 89%, 90%, 91%, 92%, 93%, 94%, 95%, 96%, 97%, 98%, or 99% identity with the entire sequence of SEQ ID NO: 140 or SEQ ID NO. 141. In another embodiment, the Tryptophan Decarboxylase gene comprises the sequence of SEQ ID NO: 140 or SEQ ID NO. 141. In yet another embodiment the Tryptophan Decarboxylase gene consists of the sequence of SEQ ID NO: 140 or SEQ ID NO. 141.

In some embodiments, the genetically engineered bacteria comprise a gene cassette for the production of tryptamine from tryptophan. In some embodiments, the genetically engineered bacteria take up tryptophan through an endogenous or exogenous transporter, and further produce tryptamine from tryptophan. In some embodiments, the genetically engineered bacteria optionally comprise a tryptophan exporter.

In some embodiments, the genetically engineered bacteria comprise one or more gene cassettes which convert tryptophan to Indole-3-aldehyde and Indole Acetic Acid, e.g., via a tryptophan aminotransferase cassette. A non-limiting example of such a tryptophan aminotransferase expressed by the genetically engineered bacteria is in Table 18. In some embodiments, the genetically engineered bacteria take up tryptophan through a endogenous or exogenous transporter, and further produce Indole-3-aldehyde and Indole Acetic Acid from tryptophan. In some embodiments, the genetically engineered bacteria optionally comprise a tryptophan exporter.

TABLE 18

Exemplary tryptophan aminotransferase sequences

| Description | Sequence |
|---|---|
| Trp aminotransferase (EC 2.6.1.27); tryptophan aminotransferase [Cryptococcus deuterogattii R265] SEQ ID NO: 142 | MTATTISIETVPQAPAAGTKTNGTSGKYNPRTYLSDRA<br>KVTEIDGSDAGRPNPDTFPFNSITLNLKPPLGLPESSNN<br>MPVSITIEDPDLATALQYAPSAGIPKLREWLADLQAHV<br>HERPRGDYAISVGSGSQDLMFKGFQAVLNPGDPVLLE<br>TPMYSGVLPALRILKADYAEVDVDDQGLSAKNLEKV<br>LSEWPADKKRPRVLYTSPIGSNPSGCSASKERKLEVLK<br>VCKKYDVLIFEDDPYYYLAQELIPSYFALEKQVYPEG<br>GHVVRFDSFSKLLSAGMRLGFATGPKEILHAIDVSTAG<br>ANLHTSAVSQGVALRLMQYWGIEGFLAHGRAVAKLY<br>TERRAQFEATAHKYLDGLATWVSPVAGMFLWIDLRP<br>AGIEDSYELIRHEALAKGVLGVPGMAFYPTGRKSSHV<br>RVSFSIVDLEDESDLGFQRLAEAIKDKRKALGLA |
| Trp aminotransferase (EC 2.6.1.27); tryptophan aminotransferase [Cryptococcus deuterogattii R265], codon optimized for expression in E. coli SEQ ID NO: 143 | ATGACGGCAACTACAATTTCTATTGAGACCGTACCT<br>CAGGCCCCGGCGGCGGGGACCAAAACTAATGGGAC<br>TTCAGGAAAATACAACCCCCGCACTTACCTGTCCGA<br>CCGCGCCAAAGTCACTGAGATTGATGGATCTGACGC<br>CGGTCGCCCCAATCCCGATACTTTCCCATTTAACTC<br>GATTACCTTAAATTTGAAACCACCTTTAGGCTTGCC<br>CGAGAGTTCAAATAACATGCCGGTCTCTATCACGAT<br>TGAAGACCCCGATTTAGCGACGGCCTTACAATATGC<br>ACCTAGCGCCGGTATTCCTAAGCTGCGCGAATGGCT<br>GGCTGACTTACAAGCTCACGTTCATGAGCGCCCCG<br>TGGCGATTATGCCATCTCGGTCGGGTCGGGGTCACA<br>GGATTTGATGTTTAAGGGCTTCCAAGCTGTCTTGAA<br>TCCAGGTGATCCAGTCCTTCTGGAAACCCCAATGTA |

TABLE 18-continued

Exemplary tryptophan aminotransferase sequences

| Description | Sequence |
|---|---|
| | TTCAGGTGTTCTGCCAGCGCTGCGCATTCTGAAGGC<br>GGATTATGCAGAAGTTGATGTAGACGACCAGGGGT<br>TATCTGCTAAAAACCTTGAAAAAGTTTTATCAGAGT<br>GGCCCGCAGATAAGAAGCGTCCTCGTGTCCTGTATA<br>CGTCGCCAATCGGCTCCAATCCTTCCGGATGTTCAG<br>CATCCAAGGAACGCAAGTTAGAGGTACTGAAAGTC<br>TGTAAGAAGTACGATGTGCTGATCTTCGAAGACGAT<br>CCGTATTATTACCTTGCTCAAGAGCTTATTCCATCCT<br>ATTTTGCGTTGGAAAAACAAGTTTATCCGGAGGGTG<br>GGCACGTTGTACGCTTTGACTCATTTAGTAAATTGC<br>TTTCTGCTGGGATGCGCTTGGGATTTGCTACAGGGC<br>CGAAGGAAATTCTTCATGCGATTGACGTCAGTACAG<br>CAGGCGCAAATTTACATACTTCAGCGGTCTCTCAAG<br>GTGTCGCTCTTCGCCTGATGCAGTATTGGGGGATCG<br>AGGGATTCCTTGCACATGGCCGCGCGGTGGCCAAA<br>CTTTACACGGAGCGCCGCGCTCAGTTCGAGGCAACC<br>GCACATAAGTACCTGGACGGGCTGGCCACTTGGGT<br>ATCTCCCGTAGCGGGAATGTTTTTATGGATCGATCT<br>TCGTCCAGCAGGAATCGAAGATTCTTACGAATTAAT<br>TCGCCATGAAGCATTAGCCAAAGGCGTTTTAGGCGT<br>TCCAGGGATGGCGTTTTATCCGACAGGCCGTAAGTC<br>TTCCCATGTTCGTGTCAGTTTCAGTATCGTCGACCTG<br>GAAGACGAATCTGACCTTGGTTTTCAACGCCTGGCT<br>GAAGCTATTAAGGATAAACGCAAGGCTTTAGGGCT<br>GGCT |

In some embodiments, the genetically engineered bacteria comprise one or more nucleic acid sequence of Table 18 or a functional fragment thereof. In some embodiments, the genetically engineered bacteria comprise a nucleic acid sequence that, but for the redundancy of the genetic code, encodes the same polypeptide as one or more nucleic acid sequence of Table 18 or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of one or more nucleic acid sequence of Table 18 or a functional fragment thereof, or a nucleic acid sequence that, but for the redundancy of the genetic code, encodes the same polypeptide as one or more nucleic acid sequence of Table 18 or a functional fragment thereof.

In one embodiment, the Trp aminotransferase gene has at least about 80% identity with the entire sequence of SEQ ID NO: 142 or SEQ ID NO: 143. In another embodiment, the Trp aminotransferase gene has at least about 85% identity with the entire sequence of SEQ ID NO: 142 or SEQ ID NO: 143. In one embodiment, the Trp aminotransferase gene has at least about 90% identity with the entire sequence of SEQ ID NO: 142 or SEQ ID NO: 143. In one embodiment, the Trp aminotransferase gene has at least about 95% identity with the entire sequence of SEQ ID NO: 142 or SEQ ID NO: 143. In another embodiment, the Trp aminotransferase gene has at least about 96%, 97%, 98%, or 99% identity with the entire sequence of SEQ ID NO: 142 or SEQ ID NO: 143. Accordingly, in one embodiment, the Trp aminotransferase gene has at least about 80%, 81%, 82%, 83%, 84%, 85%, 86%, 87%, 88%, 89%, 90%, 91%, 92%, 93%, 94%, 95%, 96%, 97%, 98%, or 99% identity with the entire sequence of SEQ ID NO: 142 or SEQ ID NO: 143. In another embodiment, the Trp aminotransferase gene comprises the sequence of SEQ ID NO: 142 or SEQ ID NO: 143. In yet another embodiment the Trp aminotransferase gene consists of the sequence of SEQ ID NO: 142 or SEQ ID NO: 143.

The genetically engineered bacteria may comprise any suitable gene for producing Indole-3-aldehyde and/or Indole Acetic Acid and/or Tryptamine. In some embodiments, the gene for producing kynurenine is modified and/or mutated, e.g., to enhance stability, increase Indole-3-aldehyde and/or Indole Acetic Acid and/or Tryptamine production, and/or increase anti-inflammatory potency under inducing conditions. In some embodiments, the engineered bacteria also have enhanced uptake or import of tryptophan, e.g., comprise a transporter or other mechanism for increasing the uptake of tryptophan into the bacterial cell, as discussed in detail above. In some embodiments, the genetically engineered bacteria are capable of producing Indole-3-aldehyde and/or Indole Acetic Acid and/or Tryptamine under inducing conditions, e.g., under a condition(s) associated with inflammation. In some embodiments, the genetically engineered bacteria are capable of producing kynurenine in low-oxygen conditions, in the presence of certain molecules or metabolites, in the presence of molecules or metabolites associated with liver damage, metabolic disease, inflammation or an inflammatory response, or in the presence of some other metabolite that may or may not be present in the gut, such as arabinose.

Also, in some embodiments, the genetically engineered bacteria are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, and (6) combinations of one or more of such additional circuits.

Tryptophan Catabolic Pathway Enzymes

In some embodiments the genetically engineered bacteria comprise one or more gene(s) or gene cassette(s) which encode one or more tryptophan pathway enzymes, e.g., from the indole pathway, the kynurenine pathway, or the serotonin arm.

Table 19 comprises polypeptide sequences of such enzymes which are encoded by the genetically engineered bacteria of the disclosure.

TABLE 19

Tryptophan Pathway Catabolic Enzymes

| Description | Sequence |
|---|---|
| TDC: Tryptophan decarboxylase from *Catharanthus roseus* SEQ ID NO: 144 | MGSIDSTNVAMSNSPVGEFKPLEAEEFRKQAHRMVDFIADY YKNVETYPVLSEVEPGYLRKRIPETAPYLPEPLDDIMKDIQK DIIPGMTNWMSPNFYAFFPATVSSAAFLGEMLSTALNSVGFT WVSSPAATELEMIVMDWLAQILKLPKSFMFSGTGGGVIQNT TSESILCTIIAARERALEKLGPDSIGKLVCYGSDQTHTMFPKT CKLAGIYPNNIRLIPTTVETDFGISPQVLRKMVEDDVAAGYV PLFLCATLGTTSTTATDPVDSLSEIANEFGIWIHVDAAYAGS ACICPEFRHYLDGIERVDSLSLSPHKWLLAYLDCTCLWVKQ PHLLLRALTTNPEYLKNKQSDLDKVVDFKNWQIATGRKFRS LKLWLILRSYGVVNLQSHIRSDVAMGKMFEEWVRSDSRFEI VVPRNFSLVCFRLKPDVSSLHVEEVNKKLLDMLNSTGRVY MTHTIVGGIYMLRLAVGSSLTEEHHVRRVWDLIQKLTDDLL KEA |
| TYNA: Monoamine oxidase from *E. coli* SEQ ID NO: 145 | MGSPSLYSARKTTLALAVALSFAWQAPVFAHGGEAHMVPM DKTLKEFGADVQWDDYAQLFTLIKDGAYVKVKPGAQTAIV NGQPLALQVPVVMKDNKAWVSDTFINDVFQSGLDQTFQVE KRPHPLNALTADEIKQAVEIVKASADFKPNTRFTEISLLPPDK EAVWAFALENKPVDQPRKADVIMLDGKHIIEAVVDLQNNK LLSWQPIKDAHGMVLLDDFASVQNIINNSEEFAAAVKKRGIT DAKKVITTPLTVGYFDGKDGLKQDARLLKVISYLDVGDGN YWAHPIENLVAVVDLEQKKIVKIEEGPVVPVPMTARPFDGR DRVAPAVKPMQIIEPEGKNYTITGDMIHWRNWDPHLSMNSR VGPMISTVTYNDNGTKRKVMYEGSLGGMIVPYGDPDIGWY FKAYLDSGDYGMGTLTSPIARGKDAPSNAVLLNETIADYTG VPMEIPRAIAVFERYAGPEYKHQEMGQPNVSTERRELVVRW ISTVGNYDYIFDWIFHENGTIGIDAGATGIEAVKGVKAKTMH DETAKDDTRYGTLIDHNIVGTTHQHIYNFRLDLDVDGENNS LVAMDPVVKPNTAGGPRTSTMQVNQYNIGNEQDAAQKFDP GTIRLLSNPNKENRMGNPVSYQIIPYAGGTHPVAKGAQFAPD EWIYHRLSFMDKQLWVTRYHPGERFPEGKYPNRSTHDTGL GQYSKDNESLDNTDAVVWMTTGTTHVARAEEWPIMPTEW VHTLLKPWNFFDETPTLGALKKDK |
| AAO1: Indole-3-acetaldehyde oxidase from *Arabidopsis thaliana* SEQ ID NO: 146 | MGEKAIDEDKVEAMKSSKTSLVFAINGQRFELELSSIDPSTTL VDFLRNKTPFKSVKLGCGEGGCGACVVLLSKYDPLLEKVDE FTISSCLTLLCSIDGCSITTSDGLGNSRVGFHAVHERIAGFHAT QCGFCTPGMSVSMFSALLNADKSHPPPRSGFSNLTAVEAEK AVSGNLCRCTGYRPLVDACKSFAADVDIEDLGFNAFCKKGE NRDEVLRRLPCYDHTSSHVCTFPEFLKKEIKNDMSLHSRKY RWSSPVSVSELQGLLEVENGLSVKLVAGNTSTGYYKEEKER KYERFIDIRKIPEFTMVRSDEKGVELGACVTISKAIEVLREEK NVSVLAKIATHMEKIANRFVRNTGTIGGNIMMAQRKQFPSD LATILVAAQATVKIMTSSSSQEQFTLEEFLQQPPLDAKSLLLS LEIPSWHSAKKNGSSEDSILLFETYRAAPRPLGNALAFLNAA FSAEVTEALDGIVVNDCQLVFGAYGTKHAHRAKKVEEFLTG KVISDEVLMEAISLLKDEIVPDKGTSNPGYRSSLAVTFLFEFF GSLTKKNAKTTNGWLNGGCKEIGFDQNVESLKPEAMLSSA QQIVENQEHSPVGKGITKAGACLQASGEAVYVDDIPAPENC LYGAFIYSTMPLARIKGIRFKQNRVPEGVLGIITYKDIPKGGQ NIGTNGFFTSDLLFAEEVTHCAGQIIAFLVADSQKHADIAAN LVVIDYDTKDLKPPILSLEEAVENFSLFEVPPPLRGYPVGDIT KGMDEAEHKILGSKISFGSQYFFYMETQTALAVPDEDNCMV VYSSTQTPEFVHQTIAGCLGVPENNVRVITRRVGGGFGGKA VKSMPVAAACALAASKMQRPVRTYVNRKTDMITTGGRHP MKVTYSVGFKSNGKITALDVEVLLDAGLTEDISPLMPKGIQ GALMKYDWGALSFNVKVCKTNTVSRTALRAPGDVQGSYIG EAIIEKVASYLSVDVDEIRKVNLHTYESLRLFHSAKAGEFSE YTLPLLWDRIDEFSGFNKRRKVVEEFNASNKWRKRGISRVP AVYAVNMRSTPGRVSVLGDGSIVVEVQGIEIGQGLWTKVK QMAAYSLGLIQCGTTSDELLKKIRVIQSDTLSMVQGSMTAG STTSEASSEAVRICCDGLVERLLPVKTALVEQTGGPVTWDSL ISQAYQQSINMSVSSKYMPDSTGEYLNYGIAASEVEVNVLT GETTILRTDIIYDCGKSLNPAVDLGQIEGAFVQGLGFFMLEEF LMNSDGLVVTDSTWTYKIPTVDTIPRQFNVEILNSGQHKNR VLSSKASGEPPLLLAASVHCAVRAAVKEARKQILSWNSNKQ GTDMYFELPVPATMPIVKEFCGLDVVEKYLEWKIQQRKNV |
| ARO9: L-tryptophan aminotransferase from *S. cerevisae* SEQ ID NO: 147 | MTAGSAPPVDYTSLKKNFQPFLSRRVENRSLKSFWDASDISD DVIELAGGMPNERFFPIESMDLKISKVPFNDNPKWHNSFTTA HLDLGSPSELPIARSFQYAETKGLPPLLHFVKDFVSRINRPAF SDETESNWDVILSGGSNDSMFKVFETICDESSTTVMIEEFTFTP AMSNVEATGAKVIPIKMNLTFDRESQGIDVEYLTQLLDNWS TGPYKDLNKPRVLYTIATGQNPTGMSVPQWKREKIYQLAQR HDFLIVEDDPYGLYFPSYNPQEPLENPYHSSDLTTERYLND FLMKSFLTLDTDARVIRLETFSKIFAPGLRLSFIVANKFLLQKI |

TABLE 19-continued

Tryptophan Pathway Catabolic Enzymes

| Description | Sequence |
| --- | --- |
| | LDLADITTRAPSGTSQAIVYSTIKAMAESNLSSSLSMKEAMF<br>EGWIRWIMQIASKYNHRKNLTLKALYETESYQAGQFTVMEP<br>SAGMFIIIKINWGNFDRPDDLPQQMDILDKFLLKNGVKVVLG<br>YKMAVCPNYSKQNSDFLRLTIAYARDDDQLIEASKRIGSGIK<br>EFFDNYKS |
| aspC: aspartate<br>aminotransferase<br>from *E. coli*<br>SEQ ID NO: 148 | MFENITAAPADPILGLADLFRADERPGKINLGIGVYKDETGK<br>TPVLTSVKKAEQYLLENETTKNYLGIDGIPEFGRCTQELLFG<br>KGSALINDKRARTAQTPGGTGALRVAADFLAKNTSVKRVW<br>VSNPSWPNHKSVFNSAGLEVREYAYYDAENHTLDFDALINS<br>LNEAQAGDVVLFHGCCHNPTGIDPTLEQWQTLAQLSVEKG<br>WLPLFDFAYQGFARGLEEDAEGLRAFAAMHKELIVASSYSK<br>NFGLYNERVGACTLVAADSETVDRAFSQMKAAIRANYSNPP<br>AHGASVVATILSNDALRAIWEQELTDMRQRIQRMRQLFVNT<br>LQEKGANRDFSFIIKQNGMFSFSGLTKEQVLRLREEFGVYAV<br>ASGRVNVAGMTPDNMAPLCEAIVAVL |
| TAA1: L-tryptophan-<br>pyruvate<br>aminotransferase<br>from *Arabidopsis<br>thaliana*<br>SEQ ID NO: 149 | MVKLENSRKPEKISNKNIPMSDFVVNLDHGDPTAYEEYWRK<br>MGDRCTVTIRGCDLMSYFSDMTNLCWFLEPELEDAIKDLHG<br>VVGNAATEDRYIVVGTGSTQLCQAAVHALSSLARSQPVSVV<br>AAAPFYSTYVEETTYVRSGMYKWEGDAWGFDKKGPYIELV<br>TSPNNPDGTIRETVVNRPDDDEAKVIHDFAYYWPHYTPITRR<br>QDHDIMLFTFSKITGHAGSRIGWALVKDKEVAKKMVEYIIV<br>NSIGVSKESQVRTAKILNVLKETCKSESESENFFKYGREMMK<br>NRWEKLREVVKESDAFTLPKYPEAFCNYFGKSLESYPAFAW<br>LGTKEETDLVSELRRHKVMSRAGERCGSDKKHVRVSMLSR<br>EDVFNVFLERLANMKLIKSIDL |
| STAO: L-tryptophan<br>oxidase from<br>*streptomyces* sp. TP-<br>A0274<br>SEQ ID NO: 150 | MTAPLQDSDGPDDAIGGPKQVTVIGAGIAGLVTAYELERLG<br>HHVQIIEGSDDIGGRIHTHRFSGAGGPGPFAEMGAMRIPAGH<br>RLTMHYIAELGLQNQVREFRTLFSDDAAYLPSSAGYLRVRE<br>AHDTLVDEFATGLPSAHYRQDTLLFGAWLDASIRAIAPRQF<br>YDGLHNDIGVELLNLVDDIDLTPYRCGTARNRIDLHALFAD<br>HPRVRASCPPRLERFLDDVLDETSSSIVRLKDGMDELPRRLA<br>SRIRGKISLGQEVTGIDVHDDTVTLTVRQGLRTVTRTCDYVV<br>CTIPFTVLRTLRLTGFDQDKLDIVHETKYWPATKIAFHCREPF<br>WEKDGISGGASFTGGHVRQTYYPPAEGDPALGAVLLASYTI<br>GPDAEALARMDEAERDALVAKELSVMHPELRRPGMVLAV<br>AGRDWGARRWSRGAATVRWGQEAALREAERRECARPQKG<br>LFFAGEHCSSKPAWIEGAIESAIDAAHEIEWYEPRASRVFAAS<br>RLSRSDRSA |
| ipdC: Indole-3-<br>pyruvate<br>decarboxylase from<br>*Enterobacter cloacae*<br>SEQ ID NO: 151 | MRTPYCVADYLLDRLTDCGADHLFGVPGDYNLQFLDHVID<br>SPDICWVGCANELNASYAADGYARCKGFAALLTTFGVGELS<br>AMNGIAGSYAEHVPVLHIVGAPGTAAQQRGELLHHTLGDG<br>EFRHFYHMSEPITVAQAVLTEQNACYEIDRVLTTMLRERRP<br>GYLMLPADVAKKAATPPVNALTHKQAHADSACLKAFRDA<br>AENKLAMSKRTALLADFLVLRHGLKHALQKWVKEVPMAH<br>ATMLMGKGIFDERQAGFYGTYSGSASTGAVKEAIEGADTVL<br>CVGTRFTDTLTAGFTHQLTPAQTIEVQPHAARVGDVWFTGI<br>PMNQAIETLVELCKQHVHAGLMSSSSGAIPFPQPDGSLTQEN<br>FWRTLQTFIRPGDIILADQGTSAFGAIDLRLPADVNFIVQPLW<br>GSIGYTLAAAFGAQTACPNRRVIVLTGDGAAQLTIQELGSM<br>LRDKQHPIILVLNNEGYTVERAIHGAEQRYNDIALWNWTHIP<br>QALSLDPQSECWRVSEAEQLADVLEKVAHHERLSLIEVMLP<br>KADIPPLLGALTKALEACNNA |
| IAD1: Indole-3-<br>acetaldehyde<br>dehydrogenase<br>from *Ustilago maydis*<br>SEQ ID NO: 152 | MPTLNLDLPNGIKSTIQADLFINNKFVPALDGKTFATINPSTG<br>KEIGQVAEASAKDVDLAVKAAREAFETTWGENTPGDARGR<br>LLIKLAELVEANIDELAAIESLDNGKAFSIAKSFDVAAVAAN<br>LRYYGGWADKNHGKVMEVDTKRLNYTRHEPIGVCGQIIPW<br>NFPLLMFAWKLGPALATGNTIVLKTAEQTPLSAIKMCELIVE<br>AGFPPGVVNVISGFGPVAGAAISQHMDIDKIAFTGSTLVGRN<br>IMKAAASTNLKKVTLELGGKSPNIIFKDADLDQAVRWSAFGI<br>MFNHGQCCCAGSRVYVEESIYDAFMEKMTAHCKALQVGDP<br>FSANTFQGPQVSQLQYDRIMEYIESGKKDANLALGGVRKGN<br>EGYFIEPTIFTDVPHDAKIAKEEIFGPVVVVSKFKDEKDLIRIA<br>NDSIYGLAAAVFSRDISRAIETAHKLKAGTVWVNCYNQLIPQ<br>VPFGGYKASGIGRELGEYALSNYTNIKAVHVNLSQPAPI |
| YUC2: indole-3-<br>pyruvate<br>monooxygenase from<br>*Arabidopsis thaliana*<br>SEQ ID NO: 153 | MEFVTETLGKRIHDPYVEETRCLMIPGPIIVGSGPSGLATAAC<br>LKSRDIPSLILERSTCIASLWQHKTYDRLRLHLPKDFCELPLM<br>PFPSSYPTYPTKQQFVQYLESYAEHFDLKPVFNQTVEEAKFD<br>RRCGLWRVRTTGGKKDETMEYVSRWLVVATGENAEEVMP<br>EIDGIPDFGGPILHTSSYKSGEIFSEKKILVVGCGNSGMEVCL<br>DLCNFNALPSLVVRDSVHVLPQEMLGISTFGISTSLLKWFPV |

TABLE 19-continued

Tryptophan Pathway Catabolic Enzymes

| Description | Sequence |
|---|---|
| | HVVDRFLLRMSRLVLGDTDRLGLVRPKLGPLERKIKCGKTP<br>VLDVGTLAKIRSGHIKVYPELKRVMHYSAEFVDGRVDNFDA<br>IILATGYKSNVPMWLKGVNMFSEKDGFPHKPFPNGWKGES<br>GLYAVGFTKLGLLGAAIDAKKIAEDIEVQRHFLPLARPQHC |
| IaaM: Tryptophan 2-<br>monooxygenase from<br>*Pseudomonas*<br>*savastanoi*<br>SEQ ID NO: 154 | MYDHFNSPSIDILYDYGPFLKKCEMTGGIGSYSAGTPTPRVA<br>IVGAGISGLVAATELLRAGVKDVVLYESRDRIGGRVWSQVF<br>DQTRPRYIAEMGAMRFPPSATGLFHYLKKFGISTSTTFPDPG<br>VVDTELHYRGKRYHWPAGKKPPELFRRVYEGWQSLLSEGY<br>LLEGGSLVAPLDITAMLKSGRLEEAAIAWQGWLNVFRDCSF<br>YNAIVCIFTGRHPPGGDRWARPEDFELFGSLGIGSGGFLPVF<br>QAGFTEILRMVINGYQSDQRLIPDGISSLAARLADQSFDGKA<br>LRDRVCFSRVGRISREAEKIIIQTEAGEQRVFDRVIVTSSNRA<br>MQMIHCLTDSESFLSRDVARAVRETHLTGSSKLFILTRTKFW<br>IKNKLPTTIQSDGLVRGVYCLDYQPDEPEGHGVVLLSYTWE<br>DDAQKMLAMPDKKTRCQVLVDDLAAIHPTFASYLLPVDGD<br>YERYVLHHDWLTDPHSAGAFKLNYPGEDVYSQRLFFQPMT<br>ANSPNKDTGLYLAGCSCSFAGGWIEGAVQTALNSACAVLRS<br>TGGQLSKGNPLDCINASYRY |
| iaaH:<br>Indoleacetamide<br>hydrolase from<br>*Pseudomonas*<br>*savastanoi*<br>SEQ ID NO: 155 | MHEIITLESLCQALADGEIAAAELRERALDTEARLARLNCFIR<br>EGDAVSQFGEADHAMKGTPLWGMPVSFKDNICVRGLPLTA<br>GTRGMSGFVSDQDAAIVSQLRALGAVVAGKNNMHELSFGV<br>TSINPHWGTVGNPVAPGYCAGGSSGGSAAAVASGIVPLSVG<br>TDTGGSIRIPAAFCGITGFRPTTGRWSTAGIIPVSHTKDCVGL<br>LTRTAGDAGFLYGLLSGKQQSFPLSRTAPCRIGLPVSMWSDL<br>DGEVERACVNALSLLRKTGFEFIEIDDADIVELNQTLTFTVPL<br>YEFFADLAQSLLSLGWKHGIHHIFAQVDDANVKGIINHHLG<br>EGAIKPAHYLSSLQNGELLKRKMDELFARHNIELLGYPTVPC<br>RVPHLDHADRPEFFSQAIRNTDLASNAMLPSITIPVGPEGRLP<br>VGLSFDALRGRDALLLSRVSAIEQVLGFVRKVLPHTT |
| TrpDH: Tryptophan<br>dehydrogenase from<br>Nostoc punctiforme<br>NIES-2108<br>SEQ ID NO: 156 | MLLFETVREMGHEQVLFCHSKNPEIKAIIAIHDTTLGPAMGA<br>TRILPYINEEAALKDALRLSRGMTYKAACANIPAGGGKAVII<br>ANPENKTDDLLRAYGRFVDSLNGRFITGQDVNITPDDVRTIS<br>QETKYVVGVSEKSGGPAPITSLGVFLGIKAAVESRWQSKRL<br>DGMKVAVQGLGNVGKNLCRHLHEHDVQLFVSDVDPIKAEE<br>VKRLFGATVVEPTEIYSLDVDIFAPCALGGILNSHTIPPLQASI<br>IAGAANNQLENEQLHSQMLAKKGILYSPDYVINAGGLINVY<br>NEMIGYDEEKAFKQVHNIYDTLLAIFEIAKEQGVTTNDAAR<br>RLAEDRINNSKRSKSKAIAA |
| CYP79B2:<br>tryptophan N-<br>monooxygenase from<br>*Arabidopsis thaliana*<br>SEQ ID NO: 157 | MNTFTSNSSDLTTTATETSSFSTLYLLSTLQAFVAITLVMLLK<br>KLMTDPNKKKPYLPPGPTGWPIIGMIPTMLKSRPVFRWLHSI<br>MKQLNTEIACVKLGNTHVITVTCPKIAREILKQQDALFASRP<br>LTYAQKILSNGYKTCVITPFGDQFKKMRKVVMTELVCPARH<br>RWLHQKRSEENDHLTAWVYNMVKNSGSVDFRFMTRHYCG<br>NAIKKLMFGTRTFSKNTAPDGGPTVEDVEHMEAMFEALGFT<br>FAFCISDYLPMLTGLDLNGHEKIMRESSAIMDKYHDPIIDERI<br>KMWREGKRTQIEDFLDIFISIKDEQGNPLLTADEIKPTIKELV<br>MAAPDNPSNAVEWAMAEMVNKPEILRKAMEEIDRVVGKE<br>RLVQESDIPKLNYVKAILREAFRLHPVAAFNLPHVALSDTTV<br>AGYHIPKGSQVLLSRYGLGRNPKVWADPLCFKPERHLNECS<br>EVTLTENDLRFISFSTGKRGCAAPALGTALTTMMLARLLQG<br>FTWKLPENETRVELMESSHDMFLAKPLVMVGDLRLPEHLYP<br>TVK |
| CYP79B3:<br>tryptophan N-<br>monooxygenase from<br>*Arabidopsis thaliana*<br>SEQ ID NO: 158 | MDTLASNSSDLTTKSSLGMSSFTNMYLLTTLQALAALCFLM<br>ILNKIKSSSRNKKLHPLPPGPTGFPIVGMIPAMLKNRPVFRWL<br>HSLMKELNTEIACVRLGNTHVIPVTCPKIAREIFKQQDALFAS<br>RPLTYAQKILSNGYKTCVITPFGEQFKKMRKVIMTEIVCPAR<br>HRWLHDNRAEETDHLTAWLYNMVKNSEPVDLRFVTRHYC<br>GNAIKRLMFGTRTFSEKTEADGGPTLEDIEHMDAMFEGLGF<br>TFAFCISDYLPMLTGLDLNGHEKIMRESSAIMDKYHDPIIDER<br>IKMWREGKRTQIEDFLDIFISIKDEAGQPLLTADEIKPTIKELV<br>MAAPDNPSNAVEWAIAEMINKPEILHKAMEEIDRVVGKERF<br>VQESDIPKLNYVKAIIREAFRLHPVAAFNLPHVALSDTTVAG<br>YHIPKGSQVLLSRYGLGRNPKVWSDPLSFKPERHLNECSEVT<br>LTENDLRFISFSTGKRGCAAPALGTAITTMMLARLLQGFKW<br>KLAGSETRVELMESSHDMFLSKPLVLVGELRLSEDLYPMVK |
| CYP71A13:<br>indoleacetaldoxime<br>dehydratase from<br>*Arabidopsis thaliana*<br>SEQ ID NO: 159 | MSNIQEMEMILSISLCLTTLITLLLLRRFLKRTATKVNLPPSP<br>WRLPVIGNLHQLSLHPHRSLRSLSLRYGPLMLLHFGRVPILV<br>VSSGEAAQEVLKTHDHKFANRPRSKAVHGLMNGGRDVVFA<br>PYGEYWRQMKSVCILNLLTNKMVESFEKVREDEVNAMIEK<br>LEKASSSSSENLSELFITLPSDVTSRVALGRKHSEDETARDL |

TABLE 19-continued

Tryptophan Pathway Catabolic Enzymes

| Description | Sequence |
|---|---|
| | KKRVRQIMELLGEFPIGEYVPILAWIDGIRGFNNKIKEVSRGF
SDLMDKVVQEHLEASNDKADFVDILLSIEKDKNSGFQVQRN
DIKFMILDMFIGGTSTTSTLLEWTMTELIRSPKSMKKLQDEIR
STIRPHGSYIKEKEVENMKYLKAVIKEVLRLHPSLPMILPRLL
SEDVKVKGYNIAAGTEVIINAWAIQRDTATWGPDAEEFKPER
HLDSGLDYHGKNLNYIPFGSGRRICPGINLALGLAEVTVANL
VGRFDWRVEAGPNGDQPDLTEAIGIDVCRKFPLIAFPSSVV |
| PEN2: myrosinase from *Arabidopsis thaliana* SEQ ID NO: 160 | MAHLQRTFPTEMSKGRASFPKGFLFGTASSSYQYEGAVNEG
ARGQSVWDHFSNRFPHRISDSSDGNVAVDFYHRYKEDIKRM
KDINMDSFRLSIAWPRVLPYGKRDRGVSEEGIKFYNDVIDEL
LANEITPLVTIFHWDIPQDLEDEYGGFLSEQIIDDFRDYASLC
FERFGDRVSLWCTMNEPWVYSVAGYDTGRKAPGRCSKYV
NGASVAGMSGYEAYIVSHNMLLAHAEAVEVFRKCDHIKNG
QIGIAHNPLWYEPYDPSDPDDVEGCNRAMDFMLGWHQHPT
ACGDYPETMKKSVGDRLPSFTPEQSKKLIGSCDYVGINYYSS
LFVKSIKHVDPTQPTWRTDQGVDWMKTNIDGKQIAKQGGS
EWSFTYPTGLRNILKYVKKTYGNPPILITENGYGEVAEQSQS
LYMYNPSIDTERLEYIEGHIHAIHQAIHEDGVRVEGYYVWSL
LDNFEWNSGYGVRYGLYYIDYKDGLRRYPKMSALWLKEFL
RFDQEDDSSTSKKEEKKESYGKQLLHSVQDSQFVHSIKDSG
ALPAVLGSLFVVSATVGTSLFFKGANN |
| Nit1: Nitrilase from *Arabidopsis thaliana* SEQ ID NO: 161 | MSSTKDMSTVQNATPFNGVAPSTTVRVTIVQSSTVYNDTPA
TIDKAEKYIVEAASKGAELVLFPEGFIGGYPRGFRFGLAVGV
HNEEGRDEFRKYHASAIHVPGPEVARLADVARKNHVYLVM
GAIEKEGYTLYCTVLFFSPQGQFLGKHRKLMPTSLERCIWGQ
GDGSTIPVYDTPIGKLGAAICWENRMPLYRTALYAKGIELYC
APTADGSKEWQSSMLHIAIEGGCFVLSACQFCQRKHFPDHP
DYLFTDWYDDKEHDSIVSQGGSVIISPLGQVLAGPNFESEGL
VTADIDLGDIARAKLYFDSVGHYSRPDVLHLTVNEHPRKSV
TFVTKVEKAEDDSNK |
| IDO1: indoleamine 2,3-dioxygenase from *homo sapiens* SEQ ID NO: 162 | MAHAMENSWTISKEYHIDEEVGFALPNPQENLPDFYNDWM
FIAKHLPDLIESGQLRERVEKLNMLSIDHLTDHKSQRLARLV
LGCITMAYVWGKGHGDVRKVLPRNIAVPYCQLSKKLELPPI
LVYADCVLANWKKKDPNKPLTYENMDVLFSFRDGDCSKGF
FLVSLLVEIAAASAIKVIPTVFKAMQMQERDTLLKALLEIAS
CLEKALQVFHQIHDHVNPKAFFSVLRIYLSGWKGNPQLSDG
LVYEGFWEDPKEFAGGSAGQSSVFQCFDVLLGIQQTAGGGH
AAQFLQDMRRYMPPAHRNFLCSLESNPSVREFVLSKGDAGL
REAYDACVKALVSLRSYHLQIVTKYILIPASQQPKENKTSED
PSKLEAKGTGGTDLMNFLKTVRSTTEKSLLKEG |
| TDO2: tryptophan 2,3-dioxygenase from *homo sapiens* SEQ ID NO: 163 | MSGCPFLGNNFGYTFKKLPVEGSEEDKSQTGVNRASKGGLI
YGNYLHLEKVLNAQELQSETKGNKIHDEHLFIITHQAYELW
FKQILWELDSVREIFQNGHVRDERNMLKVVSRMHRVSVILK
LLVQQFSILETMTALDFNDFREYLSPASGFQSLQFRLLENKIG
VLQNMRVPYNRRHYRDNFKGEENELLLKSEQEKTLLELVE
AWLERTPGLEPHGFNFWGKLEKNITRGLEEEFIRIQAKEESE
EKEEQVAEFQKQKEVLLSLFDEKRHEHLLSKGERRLSYRAL
QGALMIYFYREEPRFQVPFQLLTSLMDIDSLMTKWRYNHVC
MVHRMLGSKAGTGGSSGYHYLRSTVSDRYKVFVDLFNLST
YLIPRHWIPKMNPTIHKFLYTAEYCDSSYFSSDESD |
| BNA2: indoleamine 2,3-dioxygenase from *S. cerevisiae* SEQ ID NO: 164 | MNNTSITGPQVLHRTKMRPLPVLEKYCISPHHGFLDDRLPLT
RLSSKKYMKWEEIVADLPSLLQEDNKVRSVIDGLDVLDLDE
TILGDVRELRRAYSILGFMAHAYIWASGTPRDVLPECIARPL
LETAHILGVPPLATYSSLVLWNFKVTDECKKTETGCLDLENI
TTINTFTGTVDESWFYLVSVRFEKIGSACLNHGLQILRAIRSG
DKGDANVIDGLEGLAATIERLSKALMEMELKCEPNVFYFKI
RPFLAGWTNMSHMGLPQGVRYGAEGQYRIFSGGSNAQSSLI
QTLDILLGVKHTANAAHSSQGDSKINYLDEMKKYMPREHR
EFLYHLESVCNIREYVSRNASNRALQEAYGRCISMLKIFRDN
HIQIVTKYIILPSNSKQHGSNKPNVLSPIEPNTKASGCLGHKV
ASSKTIGTGGTRLMPFLKQCRDETVATADIKNEDKN |
| Afmid: Kynurenine formamidase from mouse SEQ ID NO: 165 | MAFPSLSAGQNPWRNLSSEELEKQYSPSRWVIHTKPEEVVG
NFVQIGSQATQKARATRRNQLDVPYGDGEGEKLDIYFPDED
SKAFPLFLFLHGGYWQSGSKDDSAFMVNPLTAQGIVVVIVA
YDIAPKGTLDQMVDQVTRSVVFLQRRYPSNEGIYLCGHSAG
AHLAAMVLLARWTKHGVTPNLQGFLLVSGIYDLEPLIATSQ
NDPLRMTLEDAQRNSPQRHLDVVPAQPVAPACPVLVLVGQ
HDSPEFHRQSKEFYETLLRVGWKASFQQLRGVDHFDIIENLT
REDDVLTQIILKTVFQKL |

TABLE 19-continued

Tryptophan Pathway Catabolic Enzymes

| Description | Sequence |
|---|---|
| BNA3: kynurenine--oxoglutarate transaminase from *S. cerevisae* SEQ ID NO: 166 | MKQRFIRQFTNLMSTSRPKVVANKYFTSNTAKDVWSLTNE AAAKAANNSKNQGRELINLGQGFFSYSPPQFAIKEAQKALDI PMVNQYSPTRGRPSLINSLIKLYSPIYNTELKAENVTVTTGA NEGILSCLMGLLNAGDEVIVFEPFFDQYIPNIELCGGKVVYV PINPPKELDQRNTRGEEWTIDFEQFEKAITSKTKAVIINTPHN PIGKVFTREELTTLGNICVKHNVVIISDEVYEHLYFTDSFTRIA TLSPEIGQLTLTVGSAGKSFAATGWRIGWVLSLNAELLSYAA KAHTRICFASPSPLQEACANSINDALKIGYFEKMRQEYINKF KIFTSIFDELGLPYTAPEGTYFVLVDFSKVKIPEDYPYPEEILN KGKDFRISHWLINELGVVAIPPTEFYIKEHEKAAENLLRFAV CKDDAYLENAVERLKLLKDYL |
| GOT2: Aspartate aminotransferase, mitochondrial from *homo sapiens* SEQ ID NO: 167 | MALLHSGRVLPGIAAAFHPGLAAAASARASSWWTHVEMGP PDPILGVTEAFKRDTNSKKMNLGVGAYRDDNGKPYVLPSV RKAEAQIAAKNLDKEYLPIGGLAEFCKASAELALGENSEVL KSGRFVTVQTISGTGALRIGASFLQRFFKFSRDVFLPKPTWG NHTPIFRDAGMQLQGYRYYDPKTCGFDFTGAVEDISKIPEQS VLLLHACAHNPTGVDPRPEQWKEIATVVKKRNLFAFFDMA YQGFASGDGDKDAWAVRHFIEQGINVCLCQSYAKNMGLYG ERVGAFTMVCKDADEAKRVESQLKILIRPMYSNPPLNGARI AAAILNTPDLRKQWLQEVKVMADRIIGMRTQLVSNLKKEGS THNWQHITDQIGMFCFTGLKPEQVERLIKEFSIYMTKDGRIS VAGVTSSNVGYLAHAIHQVTK |
| AADAT: Kynurenine/alpha-aminoadipate aminotransferase, mitochondrial SEQ ID NO: 168 | MNYARFITAASAARNPSPIRTMTDILSRGPKSMISLAGGLPNP NMFPFKTAVITVENGKTIQFGEEMMKRALQYSPSAGIPELLS WLKQLQIKLHNPPTIHYPPSQGQMDLCVTSGSQQGLCKVFE MIINPGDNVLLDEPAYSGTLQSLHPLGCNIINVASDESGIVPD SLRDILSRWKPEDAKNPQKNTPKFLYTVPNGNNPTGNSLTSE RKKEIYELARKYDFLIIEDDPYYFLQFNKFRVPTFLSMDVDG RVIRADSFSKIISSGLRIGFLTGPKPLIERVILHIQVSTLHPSTFN QLMISQLLHEWGEEGFMAHVDRVIDFYSNQKDAILAAADK WLTGLAEWHVPAAGMFLWIKVKGINDVKELIEEKAVKMG VLMLPGNAFYVDSSAPSPYLRASFSSASPEQMDVAFQVLAQ LIKESL |
| CCLB1: Kynurenine--oxoglutarate transaminase 1 from *homo sapiens* SEQ ID NO: 169 | MAKQLQARRLDGIDYNPWVEFVKLASEHDVVNLGQGFPDF PPPDFAVEAFQHAVSGDFMLNQYTKTFGYPPLTKILASFFGE LLGQEIDPLRNVLVTVGGYGALFTAFQALVDEGDEVIIIEPFF DCYEPMTMMAGGRPVFVSLKPGPIQNGELGSSSNWQLDPM ELAGKFTSRTKALVLNTPNNPLGKVFSREELELVASLCQQH DVVCITDEVYQWMVYDGHQHISIASLPGMWERTLTIGSAGK TFSATGWKVGWVLGPDHIMKHLRTVHQNSVFHCPTQSQAA VAESFEREQLLFRQPSSYFVQFPQAMQRCRDHMIRSLQSVGL KPIIPQGSYFLITDISDFKRKMPDLPGAVDEPYDRRFVKWMI KNKGLVAIPVSIFYSVPHQKHFDHYIRFCFVKDEATLQAMDE KLRKWKVEL |
| CCLB2: kynurenine--oxoglutarate transaminase 3 from *homo sapiens* SEQ ID NO: 170 | MFLAQRSLCSLSGRAKFLKTISSSKILGFSTSAKMSLKFTNAK RIEGLDSNVWIEFTKLAADPSVVNLGQGFPDISPPTYVKEELS KIAAIDSLNQYTRGFGHPSLVKALSYLYEKLYQKQIDSNKEI LVTVGAYGSLFNTIQALIDEGDEVILIVPFYDCYEPMVRMAG ATPVFIPLRSKPVYGKRWSSSDWTLDPQELESKFNSKTKAIIL NTPHNPLGKVYNREELQVIADLCIKYDTLCISDEVYEWLVYS GNKHLKIATFPGMWERTITIGSAGKTFSVTGWKLGWSIGPN HLIKHLQTVQQNTIYTCATPLQEALAQAFWIDIKRMDDPEC YFNSLPKELEVKRDRMVRLLESVGLKPIVPDGGYFIIADVSL LDPDLSDMKNNEPYDYKFVKWMTKHKKLSAIPVSAFCNSE TKSQFEKFVRFCFIKKDSTLDAAEEIIKAWSVQKS |
| TnaA: tryptophanase from *E. coli* SEQ ID NO: 171 | MENFKHLPEPFRIRVIEPVKRTTRAYREEAIIKSGMNPFLLDS EDVFIDLLTDSGTGAVTQSMQAAMMRGDEAYSGSRSYYAL AESVKNIFGYQYTIPTHQGRGAEQIYIPVLIKKREQEKGLDRS KMVAFSNYFFDTTQGHSQINGCTVRNVYIKEAFDTGVRYDF KGNFDLEGLERGIEEVGPNNVPYIVATITSNSAGGQPVSLAN LKAMYSIAKKYDIPVVMDSARFAENAYFIKQREAEYKDWTI EQITRETYKYADMLAMSAKKDAMVPMGGLLCMKDDSFFD VYTECRTLCVVQEGFPTYGGLEGGAMERLAVGLYDGMNLD WLAYRIAQVQYLVDGLEEIGVVCQQAGGHAAFVDAGKLLP HIPADQFPAQALACELYKVAGIRAVEIGSFLLGRDPKTGKQL PCPAELLRLTIPRATYTQTHMDFIIEAPKHVKENAANIKGLTF TYEPKVLRHFTAKLKEV |

In one embodiment, the tryptophan pathway catabolic enzyme has at least about 80% identity with the entire sequence of one or more of SEQ ID NO: 144 through SEQ ID NO: 171. In another embodiment, the tryptophan pathway catabolic enzyme has at least about 85% identity with the entire sequence of one or more SEQ ID NO: 144 through SEQ ID NO: 171. In one embodiment, the tryptophan pathway catabolic enzyme has at least about 90% identity with the entire sequence of one or more SEQ ID NO: 144 through SEQ ID NO: 171. In one embodiment, the tryptophan pathway catabolic enzyme has at least about 95% identity with the entire sequence of one or more SEQ ID NO: 144 through SEQ ID NO: 171. In another embodiment, the tryptophan pathway catabolic enzyme has at least about 96%, 97%, 98%, or 99% identity with the entire sequence of one or more SEQ ID NO: 144 through SEQ ID NO: 171. Accordingly, in one embodiment, the tryptophan pathway catabolic enzyme has at least about 80%, 81%, 82%, 83%, 84%, 85%, 86%, 87%, 88%, 89%, 90%, 91%, 92%, 93%, 94%, 95%, 96%, 97%, 98%, or 99% identity with the entire sequence of one or more SEQ ID NO: 144 through SEQ ID NO: 171. In another embodiment, the tryptophan pathway catabolic enzyme comprises the sequence of one or more SEQ ID NO: 144 through SEQ ID NO: 171. In yet another embodiment the tryptophan pathway catabolic enzyme consists of the sequence of one or more SEQ ID NO: 144 through SEQ ID NO: 171.

ALE

E. coli Nissle can be engineered to efficiently import KYN and convert it to TRP. While Nissle does not typically utilize KYN, by introducing the Kynureninase (KYNase) from Pseudomonas fluorescens (kynU) on a medium-copy plasmid under the control of the tetracycline promoter (Ptet) a new strain with this plasmid (Ptet-KYNase) is able to convert L-kynurenine into anthranilate. E. coli naturally utilizes anthranilate in its TRP biosynthetic pathway. Briefly, the TrpE (in complex with TrpD) enzyme converts chorismate into anthranilate. TrpD, TrpC, TrpA and TrpB then catalyzes a five-step reaction ending with the condensation of an indole with serine to form tryptophan. By replacing the TrpE enzyme via lambda-RED recombineering, the subsequent strain of Nissle (AtrpE::Cm) is an auxotroph unable to grow in minimal media without supplementation of TRP or anthranilate. By expressing kynureninase in AtrpE::Cm (KYNase-trpE), this auxotrophy can be alternatively rescued by providing KYN.

Leveraging the growth-limiting nature of KYN in KYNase-trpE, adaptive laboratory evolution was employed to further evolve a strain capable of increasingly efficient utilization of KYN. First a lower limit of KYN concentration was established and mutants were evolved by passaging in lowering concentrations of KYN. While this can select for mutants capable of increasing KYN import, the bacterial cells still prefer to utilize free, exogenous TRP. In the tumor environment, dual-therapeutic functions can be provided by depletion of KYN and increasing local concentrations of TRP. Therefore, to evolve a strain which prefers KYN over TRP, a toxic analogue of TRP—5-fluoro-L-tryptophan (Tox-TRP)—can be incorporated into the ALE experiment. The resulting best performing strain is then whole genome sequenced in order to deconvolute the contributing mutations. Lambda-RED can be performed in order to reintroduce TrpE, to inactivate Trp regulation (trpR, tyrR, transcriptional attenuators) to up-regulate TrpABCDE expression and increase chorismate production. The resulting strain is now insensitive to external TRP, efficiently converts KYN into TRP, and also now overproduces TRP.

In some embodiments, the genetically engineered bacteria comprise one or more nucleic acid sequence of Table 3B or a functional fragment thereof. In some embodiments, the genetically engineered bacteria comprise a nucleic acid sequence that, but for the redundancy of the genetic code, encodes the same polypeptide as one or more nucleic acid sequence of Table 3B or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of one or more nucleic acid sequence of Table 3B or a functional fragment thereof, or a nucleic acid sequence that, but for the redundancy of the genetic code, encodes the same polypeptide as one or more nucleic acid sequence of Table 3B or a functional fragment thereof In some embodiments, the genetically engineered bacteria encode a gene or gene cassette, which promotes anti-inflammatory activity. In some embodiments, the genetically engineered bacteria are capable of producing kynurenine.

In some embodiments, this step involves the conversion of tryptophan to kynurenine, and may be catalyzed by the ubiquitously-expressed enzyme indoleamine 2,3-dioxygenase (IDO-1), or by tryptophan dioxygenase (TDO), an enzyme which is primarily localized to the liver (Alvarado et al., 2015). The genetically engineered bacteria may comprise any suitable gene for producing kynurenine. In some embodiments, the genetically engineered bacteria may comprise one or more gene(s) or gene cassette(s) for producing a tryptophan transporter, a gene or gene cassette for producing IDO-1, and a gene or gene cassette for producing TDO. In some embodiments, the genetically engineered bacteria comprise a gene encoding kynurenine formamidase.

In some embodiments, the genetically engineered bacteria comprise one or more gene(s) or gene cassette(s) for the consumption of tryptophan and production of kynurenine, which are bacterially derived. In some embodiments, the enzymes for TRP to KYN conversion are derived from one or more of Pseudomonas, Xanthomonas, Burkholderia, Stenotrophomonas, Shewanella, and Bacillus, and/or members of the families Rhodobacteraceae, Micrococcaceae, and Halomonadaceae, In some embodiments the enzymes are derived from the species listed in table S7 of Vujkovic-Cvijin et al. (Dysbiosis of the gut microbiota is associated with HIV diseaseprogression and tryptophan catabolism Sci Transl Med. 2013 Jul. 10; 5(193): 193ra91), the contents of which is herein incorporated by reference in its entirety.

In some embodiments, the one or more genes for producing kynurenine are modified and/or mutated, e.g., to enhance stability, increase kynurenine production, and/or increase anti-inflammatory potency under inducing conditions. In some embodiments, the engineered bacteria have enhanced uptake or import of tryptophan, e.g., comprise a transporter or other mechanism for increasing the uptake of tryptophan into the bacterial cell. In some embodiments, the genetically engineered bacteria are capable of producing kynurenine under inducing conditions, e.g., under a condition(s) associated with inflammation. In some embodiments, the genetically engineered bacteria are capable of producing kynurenine in low-oxygen conditions. In some embodiments, the genetically engineered bacteria are capable of producing kynurenic acid. Kynurenic acid is produced from the irreversible transamination of kynurenine in a reaction catalyzed by the enzyme kynurenine-oxoglutarate transaminase. In some embodiments, The genetically engineered bacteria may comprise any suitable gene for producing kynurenic acid. In some embodiments, the gene for producing kynurenic acid is modified and/or mutated, e.g., to enhance stability, increase kynurenic acid production, and/or increase anti-inflammatory potency under inducing conditions. In some embodiments, the genetically engineered bacteria are capable of producing kynurenic acid under inducing conditions, e.g., under a condition(s) associated with inflammation. In some embodiments, the genetically engineered bacteria are capable of producing kynurenic acid in low-oxygen conditions.

In some embodiments, the genetically engineered bacteria comprising one or more gene(s) or gene cassette(s) can alter the TRP:KYN ratio, e.g. in the circulation. In some embodiments the TRP:KYN ratio is increased. In some embodiments, TRP:KYN ratio is decreased. some embodiments, the genetically engineered bacteria the genetically engineered bacteria comprising one or more gene(s) or gene cassette(s) can alter the KYNA:QUIN ratio.

In some embodiments, the genetically engineered bacteria are capable of expressing any one or more of the described circuits in low-oxygen conditions, in the presence of disease or tissue specific molecules or metabolites, in the presence of molecules or metabolites associated with inflammation or an inflammatory response or immune suppression, liver damage, metabolic disease, or in the presence of some other metabolite that may or may not be present in the gut or the tumor micorenvironment, such as arabinose. In some embodiments, any one or more of the described circuits are present on one or more plasmids (e.g., high copy or low copy) or are integrated into one or more sites in the bacterial chromosome. Also, in some embodiments, the genetically engineered bacteria are further capable of expressing any one or more of the described circuits and further comprise one or more of the following: (1) one or more auxotrophies, such as any auxotrophies known in the art and provided herein, e.g., thyA auxotrophy, (2) one or more kill switch circuits, such as any of the kill-switches described herein or otherwise known in the art, (3) one or more antibiotic resistance circuits, (4) one or more transporters for importing biological molecules or substrates, such any of the transporters described herein or otherwise known in the art, (5) one or more secretion circuits, such as any of the secretion circuits described herein and otherwise known in the art, and (6) combinations of one or more of such additional circuits.

Tryptophan Repressor (TrpR)

In any of these embodiments, the tryptophan repressor (trpR) optionally may be deleted, mutated, or modified so as to diminish or obliterate its repressor function. Also, in any of these embodiments, the genetically engineered bacteria optionally comprise gene sequence(s) to produce the tryptophan precursor, Chorismate, e.g., sequence(s) encoding aroG, aroF, aroH, aroB, aroD, aroE, aroK, and AroC.

Tryptophan and Tryptophan Metabolite Transport

Metabolite transporters may further be expressed or modified in the genetically engineered bacteria of the invention in order to enhance tryptophan or KP metabolite transport into the cell.

The inner membrane protein YddG of *E. coli*, encoded by the yddG gene, is a homologue of the known amino acid exporters RhtA and YdeD. Studies have shown that YddG is capable of exporting aromatic amino acids, including tryptophan. Thus, YddG can function as a tryptophan exporter or a tryptophan secretion system (or tryptophan secretion protein). Other aromatic amino acid exporters are described in Doroshenko et al., FEMS Microbiol. Lett., 275:312-318 (2007). Thus, in some embodiments, the engineered bacteria optionally further comprise gene sequence(s) encoding YddG. In some embodiments, the engineered bacteria can over-express YddG. In some embodiments, the engineered bacteria optionally comprise one or more copies of yddG gene.

In some embodiments, the engineered microbe has a mechanism for importing (transporting) Kynurenine from the local environment into the cell. Thus, in some embodiments, the genetically engineered bacteria comprise gene sequence(s) encoding a kynureninase secreter. In some embodiments, the genetically engineered bacteria comprise one or more copies of aroP, tnaB or mtr gene.

In some embodiments the genetically engineered bacteria comprise a transporter to facilitate uptake of tryptophan into the cell. Three permeases, Mtr, TnaB, and AroP, are involved in the uptake of L-tryptophan in *Escherichia coli*. In some embodiments, the genetically engineered bacteria comprise one or more copies of one or more of Mtr, TnaB, and AroP.

In some embodiments, the genetically engineered bacteria of the invention also comprise multiple copies of the transporter gene. In some embodiments, the genetically engineered bacteria of the invention also comprise a transporter gene from a different bacterial species. In some embodiments, the genetically engineered bacteria of the invention comprise multiple copies of a transporter gene from a different bacterial species. In some embodiments, the native transporter gene in the genetically engineered bacteria of the invention is not modified. In some embodiments, the genetically engineered bacteria of the invention comprise a transporter gene that is controlled by its native promoter, an inducible promoter, or a promoter that is stronger than the native promoter, e.g., a GlnRS promoter, a P(Bla) promoter, or a constitutive promoter.

In some embodiments, the native transporter gene in the genetically engineered bacteria is not modified, and one or more additional copies of the native transporter gene are inserted into the genome under the control of the same inducible promoter that controls expression of the payload, e.g., a FNR promoter, or a different inducible promoter than the one that controls expression of the payload or a constitutive promoter. In alternate embodiments, the native transporter gene is not modified, and a copy of a non-native transporter gene from a different bacterial species is inserted into the genome under the control of the same inducible promoter that controls expression of the payload, e.g., a FNR promoter, or a different inducible promoter than the one that controls expression of the payload or a constitutive promoter.

In some embodiments, the native transporter gene in the genetically engineered bacteria is not modified, and one or more additional copies of the native transporter gene are present in the bacteria on a plasmid and under the control of the same inducible promoter that controls expression of the payload e.g., a FNR promoter, or a different inducible promoter than the one that controls expression of the payload or a constitutive promoter. In alternate embodiments, the native transporter gene is not modified, and a copy of a non-native transporter gene from a different bacterial species is present in the bacteria on a plasmid and under the control of the same inducible promoter that controls expression of the payload, e.g., a FNR promoter, or a different inducible promoter than the one that controls expression of the payload or a constitutive promoter.

In some embodiments, the native transporter gene is mutagenized, the mutants exhibiting increased ammonia transport are selected, and the mutagenized transporter gene is isolated and inserted into the genetically engineered bacteria. In some embodiments, the native transporter gene is mutagenized, mutants exhibiting increased ammonia transport are selected, and those mutants are used to produce the bacteria of the invention. The transporter modifications described herein may be present on a plasmid or chromosome.

In some embodiments, the genetically engineered bacterium is E. coli Nissle, and the native transporter gene in E. coli Nissle is not modified; one or more additional copies the native E. coli Nissle transporter genes are inserted into the E. coli Nissle genome under the control of the same inducible promoter that controls expression of the payload e.g., a FNR promoter, or a different inducible promoter than the one that controls expression of the payload or a constitutive promoter. In an alternate embodiment, the native transporter gene in E. coli Nissle is not modified, and a copy of a non-native transporter gene from a different bacterium, e.g., Lactobacillus plantarum, is inserted into the E. coli Nissle genome under the control of the same inducible promoter that controls expression of the payload, e.g., a FNR promoter, or a different inducible promoter than the one that controls expression of the payload or a constitutive promoter.

In some embodiments, the genetically engineered bacterium is E. coli Nissle, and the native transporter gene in E. coli Nissle is not modified; one or more additional copies the native E. coli Nissle transporter genes are present in the bacterium on a plasmid and under the control of the same inducible promoter that controls expression of the payload, e.g., a FNR promoter, or a different inducible promoter than the one that controls expression of the payload, or a constitutive promoter. In an alternate embodiment, the native transporter gene in E. coli Nissle is not modified, and a copy of a non-native transporter gene from a different bacterium, e.g., Lactobacillus plantarum, are present in the bacterium on a plasmid and under the control of the same inducible promoter that controls expression of the payload, e.g., a FNR promoter, or a different inducible promoter than the one that controls expression of the payload, or a constitutive promoter.

Inhibitory and Targeting Molecules

In some embodiments, the genetically engineered bacteria of the invention are capable of producing a molecule that is capable of inhibiting a metabolic disease-promoting molecule. The genetically engineered bacteria may express any suitable inhibitory molecule, e.g., a single-chain variable fragment (scFv), antisense RNA, siRNA, or shRNA, that is capable of neutralizing one or more metabolic disease-promoting molecules, e.g., dipeptidyl peptidase-4 (DPP-4) or ghrelin receptor. The genetically engineered bacteria may inhibit one or more metabolic disease-promoting molecules.

RNA interference (RNAi) is a post-transcriptional gene silencing mechanism in plants and animals. RNAi is activated when microRNA (miRNA), double-stranded RNA (dsRNA), or short hairpin RNA (shRNA) is processed into short interfering RNA (siRNA) duplexes (Keates et al., 2008). RNAi can be "activated in vitro and in vivo by non-pathogenic bacteria engineered to manufacture and deliver shRNA to target cells" such as mammalian cells (Keates et al., 2008). In some embodiments, the genetically engineered bacteria of the invention induce RNAi-mediated gene silencing of one or more metabolic disease-promoting molecules in low-oxygen conditions, in the presence of certain molecules or metabolites, in the presence of molecules or metabolites associated with liver damage, metabolic disease, inflammation or an inflammatory response, or in the presence of some other metabolite that may or may not be present in the gut, such as arabinose. In some embodiments, the genetically engineered bacteria produce siRNA targeting DPP-4 in low-oxygen conditions, in the presence of certain molecules or metabolites, in the presence of molecules or metabolites associated with liver damage, metabolic disease, inflammation or an inflammatory response, or in the presence of some other metabolite that may or may not be present in the gut, such as arabinose.

Single-chain variable fragments (scFv) are "widely used antibody fragments . . . produced in prokaryotes" (Frenzel et al., 2013). scFv lacks the constant domain of a traditional antibody and expresses the antigen-binding domain as a single peptide. Bacteria such as Escherichia coli are capable of producing scFv that target a variety of molecules, e.g., TNF (Hristodorov et al., 2014). In some embodiments, the genetically engineered bacteria of the invention express a binding protein for neutralizing one or more metabolic disease-promoting molecules in low-oxygen conditions, in the presence of certain molecules or metabolites, in the presence of molecules or metabolites associated with liver damage, metabolic disease, inflammation or an inflammatory response, or in the presence of some other metabolite that may or may not be present in the gut, such as arabinose. In some embodiments, the genetically engineered bacteria produce scFv targeting DPP-4 in low-oxygen conditions, in the presence of certain molecules or metabolites, in the presence of molecules or metabolites associated with liver damage, metabolic disease, inflammation or an inflammatory response, or in the presence of some other metabolite that may or may not be present in the gut, such as arabinose. In some embodiments, the genetically engineered bacteria produce both scFv and siRNA targeting one or more metabolic disease-promoting molecules in low-oxygen conditions, in the presence of certain molecules or metabolites, in the presence of molecules or metabolites associated with liver damage, metabolic disease, inflammation or an inflammatory response, or in the presence of some other metabolite that may or may not be present in the gut, such as arabinose (see, e.g., Xiao et al., 2014).

Generation of Bacterial Strains with Enhanced Ability to Transport Amino Acids

Due to their ease of culture, short generation times, very high population densities and small genomes, microbes can be evolved to unique phenotypes in abbreviated timescales. Adaptive laboratory evolution (ALE) is the process of passaging microbes under selective pressure to evolve a strain with a preferred phenotype. Most commonly, this is applied to increase utilization of carbon/energy sources or adapting a strain to environmental stresses (e.g., temperature, pH), whereby mutant strains more capable of growth on the carbon substrate or under stress will outcompete the less adapted strains in the population and will eventually come to dominate the population.

This same process can be extended to any essential metabolite by creating an auxotroph. An auxotroph is a strain incapable of synthesizing an essential metabolite and must therefore have the metabolite provided in the media to grow. In this scenario, by making an auxotroph and passaging it on decreasing amounts of the metabolite, the resulting dominant strains should be more capable of obtaining and incorporating this essential metabolite.

For example, if the biosynthetic pathway for producing an amino acid is disrupted a strain capable of high-affinity capture of said amino acid can be evolved via ALE. First, the strain is grown in varying concentrations of the auxotrophic amino acid, until a minimum concentration to support growth is established. The strain is then passaged at that concentration, and diluted into lowering concentrations of the amino acid at regular intervals. Over time, cells that are most competitive for the amino acid—at growth-limiting concentrations—will come to dominate the population. These strains will likely have mutations in their amino acid-transporters resulting in increased ability to import the essential and limiting amino acid.

Similarly, by using an auxotroph that cannot use an upstream metabolite to form an amino acid, a strain can be evolved that not only can more efficiently import the upstream metabolite, but also convert the metabolite into the essential downstream metabolite. These strains will also evolve mutations to increase import of the upstream metabolite, but may also contain mutations which increase expression or reaction kinetics of downstream enzymes, or that reduce competitive substrate utilization pathways.

A metabolite innate to the microbe can be made essential via mutational auxotrophy and selection applied with growth-limiting supplementation of the endogenous metabolite. However, phenotypes capable of consuming non-native compounds can be evolved by tying their consumption to the production of an essential compound. For example, if a gene from a different organism is isolated which can produce an essential compound or a precursor to an essential compound this gene can be recombinantly introduced and expressed in the heterologous host. This new host strain will now have the ability to synthesize an essential nutrient from a previously non-metabolizable substrate.

Hereby, a similar ALE process can be applied by creating an auxotroph incapable of converting an immediately downstream metabolite and selecting in growth-limiting amounts of the non-native compound with concurrent expression of the recombinant enzyme. This will result in mutations in the transport of the non-native substrate, expression and activity of the heterologous enzyme and expression and activity of downstream native enzymes. It should be emphasized that the key requirement in this process is the ability to tether the consumption of the non-native metabolite to the production of a metabolite essential to growth.

Once the basis of the selection mechanism is established and minimum levels of supplementation have been established, the actual ALE experimentation can proceed. Throughout this process several parameters must be vigilantly monitored. It is important that the cultures are maintained in an exponential growth phase and not allowed to reach saturation/stationary phase. This means that growth rates must be check during each passaging and subsequent dilutions adjusted accordingly. If growth rate improves to such a degree that dilutions become large, then the concentration of auxotrophic supplementation should be decreased such that growth rate is slowed, selection pressure is increased and dilutions are not so severe as to heavily bias subpopulations during passaging. In addition, at regular intervals cells should be diluted, grown on solid media and individual clones tested to confirm growth rate phenotypes observed in the ALE cultures.

Predicting when to halt the stop the ALE experiment also requires vigilance. As the success of directing evolution is tied directly to the number of mutations "screened" throughout the experiment and mutations are generally a function of errors during DNA replication, the cumulative cell divisions (CCD) acts as a proxy for total mutants which have been screened. Previous studies have shown that beneficial phenotypes for growth on different carbon sources can be isolated in about 1011.2 CCD1. This rate can be accelerated by the addition of chemical mutagens to the cultures—such as N-methyl-N-nitro-N-nitrosoguanidine (NTG)—which causes increased DNA replication errors. However, when continued passaging leads to marginal or no improvement in growth rate the population has converged to some fitness maximum and the ALE experiment can be halted.

At the conclusion of the ALE experiment, the cells should be diluted, isolated on solid media and assayed for growth phenotypes matching that of the culture flask. Best performers from those selected are then prepped for genomic DNA and sent for whole genome sequencing. Sequencing with reveal mutations occurring around the genome capable of providing improved phenotypes, but will also contain silent mutations (those which provide no benefit but do not detract from desired phenotype). In cultures evolved in the presence of NTG or other chemical mutagen, there will be significantly more silent, background mutations. If satisfied with the best performing strain in its current state, the user can proceed to application with that strain. Otherwise the contributing mutations can be deconvoluted from the evolved strain by reintroducing the mutations to the parent strain by genome engineering techniques. See Lee, D.-H., Feist, A. M., Barrett, C. L. & Palsson, B. Ø. Cumulative Number of Cell Divisions as a Meaningful Timescale for Adaptive Laboratory Evolution of *Escherichia coli*. PLoS ONE 6, e26172 (2011).

Similar methods can be used to generate *E. coli* Nissle mutants that consume or import tryptophan and/or kynurenine.

Inducible Promoters

In some embodiments, the bacterial cell comprises a stably maintained plasmid or chromosome carrying the gene or genes for producing one or more payload molecules or the gene or genes for encoding one or more payload polypeptides. Herein the term "payload" is used to refer to butyrate, propionate, acetate, GLP-1, GLP-2, a manganese transporter, a GABA transporter, a tryptophan transporter, aromatic amino acid transporter, a kynureninase, a kynurenine-oxoglutarate transaminase (kynurenine aminotransferase, e.g., KAT I, II, III), polypeptides for metabolizing (catabolizing) GABA, and a gut-barrier enhancing molecule. In some embodiments, the gene, gene(s), or gene cassettes for producing the payload(s) is present on a plasmid and operably linked to a directly or indirectly inducible promoter. In some embodiments, the gene gene, gene(s), or gene cassettes for producing the payload(s) is present on a plasmid and operably linked to a promoter that is induced under low-oxygen or anaerobic conditions. In some embodiments, the gene, gene(s), or gene cassettes for producing the payload(s) is present on a chromosome and operably linked to a directly or indirectly inducible promoter. In some embodiments, the gene, gene(s), or gene cassettes for producing the payload(s) is present in the chromosome and operably linked to a promoter that is induced under low-oxygen or anaerobic conditions. In some embodiments, the gene, gene(s), or gene cassettes for producing the payload(s) is present on a plasmid and operably linked to a promoter that is induced by exposure to tetracycline or arabinose.

In some embodiments, the bacterial cell comprises a stably maintained plasmid or chromosome carrying at least one gene, gene(s), or gene cassettes for producing the payload(s) such that the payload(s) can be expressed in the host cell, and the host cell is capable of survival and/or growth in vitro, e.g., in medium, and/or in vivo, e.g., in the gut. In some embodiments, bacterial cell comprises two or more distinct copies of the at least one gene, gene(s), or gene cassettes for producing the payload(s). In some embodiments, the genetically engineered bacteria comprise multiple copies of the same at least one gene, gene(s), or gene cassettes for producing the payload(s). In some embodiments, the at least one gene, gene(s), or gene cassettes for producing the payload(s) is present on a plasmid and operably linked to a directly or indirectly inducible promoter. In some embodiments, the at least one gene, gene(s), or gene cassettes for producing the payload(s) is present on a plasmid and operably linked to a promoter that is induced under low-oxygen or anaerobic conditions. In some embodiments, the at least one gene, gene(s), or gene cassettes for producing the payload(s) is present on a chromosome and operably linked to a directly or indirectly inducible promoter. In some embodiments, the at least one gene, gene(s), or gene cassettes for producing the payload(s) is present in the chromosome and operably linked to a promoter that is induced under low-oxygen or anaerobic conditions. In some embodiments, the at least one gene, gene(s), or gene cassettes for producing the payload(s) is present on a plasmid and operably linked to a promoter that is induced by exposure to tetracycline.

In some embodiments, the promoter that is operably linked to the gene, gene(s), or gene cassettes for producing the payload(s) is directly induced by exogenous environmental conditions. In some embodiments, the promoter that is operably linked to the gene, gene(s), or gene cassettes for producing the payload(s) is indirectly induced by exogenous environmental conditions. In some embodiments, the promoter is directly or indirectly induced by exogenous environmental conditions specific to the gut of a mammal. In some embodiments, the promoter is directly or indirectly induced by exogenous environmental conditions specific to the small intestine of a mammal. In some embodiments, the promoter is directly or indirectly induced by low-oxygen or anaerobic conditions such as the environment of the mammalian gut. In some embodiments, the promoter is directly or indirectly induced by molecules or metabolites that are specific to the gut of a mammal, e.g., propionate. In some embodiments, the promoter is directly or indirectly induced by a molecule that is co-administered with the bacterial cell.

In some embodiments, the bacterial cell comprises a stably maintained plasmid or chromosome carrying the at least one gene, gene(s), or gene cassettes for producing the payload(s) such that the payload(s) can be expressed in the host cell, and the host cell is capable of survival and/or growth in vitro, e.g., in medium, and/or in vivo, e.g., in the gut. In some embodiments, bacterial cell comprises two or more distinct copies of the at least one gene, gene(s), or gene cassettes for producing the payload(s). In some embodiments, the genetically engineered bacteria comprise multiple copies of the same at least one gene, gene(s), or gene cassettes for producing the payload(s). In some embodiments, the at least one gene, gene(s), or gene cassettes for producing the payload(s) is present on a plasmid and operably linked to a directly or indirectly inducible promoter. In some embodiments, the at least one gene, gene(s), or gene cassettes for producing the payload(s) is present on a plasmid and operably linked to a promoter that is induced under low-oxygen or anaerobic conditions. In some embodiments, the at least one gene, gene(s), or gene cassettes for producing the payload(s) is present on a plasmid and operably linked to a promoter that is induced by exposure to tetracycline.

In some embodiments, the promoter that is operably linked to the gene, gene(s), or gene cassettes for producing the payload(s) is directly induced by exogenous environmental conditions. In some embodiments, the promoter that is operably linked to the gene, gene(s), or gene cassettes for producing the payload(s) is indirectly induced by exogenous environmental conditions. In some embodiments, the promoter is directly or indirectly induced by exogenous environmental conditions specific to the gut of a mammal. In some embodiments, the promoter is directly or indirectly induced by exogenous environmental conditions specific to the small intestine of a mammal. In some embodiments, the promoter is directly or indirectly induced by low-oxygen or anaerobic conditions such as the environment of the mammalian gut. In some embodiments, the promoter is directly or indirectly induced by molecules or metabolites that are specific to the gut of a mammal, e.g., propionate. In some embodiments, the promoter is directly or indirectly induced by a molecule that is co-administered with the bacterial cell.

FNR-Dependent Regulation

In certain embodiments, the bacterial cell comprises a gene, gene(s), or gene cassettes for producing the payload(s) is expressed under the control of the fumarate and nitrate reductase regulator (FNR) promoter. In certain embodiments, the bacterial cell comprises at least one gene, gene(s), or gene cassettes for producing the payload(s) is expressed under the control of the fumarate and nitrate reductase regulator (FNR) promoter. In certain embodiments, the bacterial cell comprises at least one gene, gene(s), or gene cassettes for producing the payload(s) is expressed under the control of the fumarate and nitrate reductase regulator (FNR) promoter. In *E. coli*, FNR is a major transcriptional activator that controls the switch from aerobic to anaerobic metabolism (Unden et al., 1997). In the anaerobic state, FNR dimerizes into an active DNA binding protein that activates hundreds of genes responsible for adapting to anaerobic growth. In the aerobic state, FNR is prevented from dimerizing by oxygen and is inactive.

FNR responsive promoters include, but are not limited to, the FNR responsive promoters listed in the chart, below. Underlined sequences are predicted ribosome binding sites, and bolded sequences are restriction sites used for cloning.

TABLE 20

FNR Promoter Sequences

| FNR Responsive Promoter | Sequence |
|---|---|
| SEQ ID NO: 172 | GTCAGCATAACACCCTGACCTCTCATTAATTGTTCATGCCGGGC GGCACTATCGTCGTCCGGCCTTTTCCTCTCTTACTCTGCTACGT ACATCTATTTCTATAAATCCGTTCAATTTGTCTGTTTTTTGCAC AAACATGAAATATCAGACAATTCCGTGACTTAAGAAAATTTATA CAAATCAGCAATATACCCCTTAAGGAGTATATAAAGGTGAATTT GATTTACATCAATAAGCGGGGTTGCTGAATCGTTAAGGTAGGCG GTAATAG<u>AAAAGAAATCGAGGCAAAA</u> |
| SEQ ID NO: 173 | ATTTCCTCTCATCCCATCCGGGGTGAGAGTCTTTTCCCCCGACT TATGGCTCATGCATGCATCAAAAAAGATGTGAGCTTGATCAAAA ACAAAAAATATTTCACTCGACAGGAGTATTTATATTGCGCCCGT TACGTGGGCTTCGACTGTAAATC<u>AGAAAGGAGAAAACACCT</u> |

TABLE 20-continued

FNR Promoter Sequences

| FNR Responsive Promoter | Sequence |
|---|---|
| SEQ ID NO: 174 | GTCAGCATAACACCCTGACCTCTCATTAATTGTTCATGCCGGGC GGCACTATCGTCGTCCGGCCTTTTCCTCTCTTACTCTGCTACGT ACATCTATTTCTATAAATCCGTTCAATTTGTCTGTTTTTTGCAC AAACATGAAATATCAGACAATTCCGTGACTTAAGAAAATTTATA CAAATCAGCAATATACCCCTTAAGGAGTATATAAAGGTGAATTT GATTTACATCAATAAGCGGGGTTGCTGAATCGTTAAGGATCCCT CTAGAAATAATTTTGTTTAACTTTAAGAAGGAGATATACAT |
| SEQ ID NO: 175 | CATTTCCTCTCATCCCATCCGGGGTGAGAGTCTTTTCCCCCGAC TTATGGCTCATGCATGCATCAAAAAAGATGTGAGCTTGATCAAA AACAAAAAATATTTCACTCGACAGGAGTATTTATATTGCGCCCG GATCCCTCTAGAAATAATTTTGTTTAACTTTAAGAAGGAGATAT ACAT |
| SEQ ID NO: 176 | AGTTGTTCTTATTGGTGGTGTTGCTTTATGGTTGCATCGTAGTA AATGGTTGTAACAAAAGCAATTTTTCCGGCTGTCTGTATACAAA AACGCCGTAAAGTTTGAGCGAAGTCAATAAACTCTCTACCCATT CAGGGCAATATCTCTCTTGGATCCCTCTAGAAATAATTTTGTTT AACTTTAAGAAGGAGATATACAT |

In one embodiment, the FNR responsive promoter comprises SEQ ID NO:172. In another embodiment, the FNR responsive promoter comprises SEQ ID NO:173. In another embodiment, the FNR responsive promoter comprises SEQ ID NO:174. In another embodiment, the FNR responsive promoter comprises SEQ ID NO:175. In yet another embodiment, the FNR responsive promoter comprises SEQ ID NO:176. Additional FNR responsive promoters are shown below.

TABLE 21

FNR Promoter sequences

| FNR-responsive regulatory region | 123456789012345678901234567890123456789012345 67890 |
|---|---|
| SEQ ID NO: 177 | ATCCCCATCACTCTTGATGGAGATCAATTCCCCAAGCTGCTAG AGCGTTACCTTGCCCTTAAACATTAGCAATGTCGATTTATCAG AGGGCCGACAGGCTCCCACAGGAGAAAACCG |
| SEQ ID NO: 178 | CTCTTGATCGTTATCAATTCCCACGCTGTTTCAGAGCGTTACC TTGCCCTTAAACATTAGCAATGTCGATTTATCAGAGGGCCGAC AGGCTCCCACAGGAGAAAACCG |
| nirB1 SEQ ID NO: 179 | GTCAGCATAACACCCTGACCTCTCATTAATTGTTCATGCCGGG CGGCACTATCGTCGTCCGGCCTTTTCCTCTCTTACTCTGCTAC GTACATCTATTTCTATAAATCCGTTCAATTTGTCTGTTTTTTG CACAAACATGAAATATCAGACAATTCCGTGACTTAAGAAAATT TATACAAATCAGCAATATACCCCTTAAGGAGTATATAAAGGTG AATTTGATTTACATCAATAAGCGGGGTTGCTGAATCGTTAAGG TAGGCGGTAATAGAAAAGAAATCGAGGCAAAA |
| nirB2 SEQ ID NO: 180 | CGGCCCGATCGTTGAACATAGCGGTCCGCAGGCGGCACTGCTT ACAGCAAACGGTCTGTACGCTGTCGTCTTTGTGATGTGCTTCC TGTTAGGTTTCGTCAGCCGTCACCGTCAGCATAACACCCTGAC CTCTCATTAATTGCTCATGCCGGACGGCACTATCGTCGTCCGG CCTTTTCCTCTCTTCCCCCGCTACGTGCATCTATTTCTATAAA CCCGCTCATTTTGTCTATTTTTTGCACAAACATGAAATATCAG ACAATTCCGTGACTTAAGAAAATTTATACAAATCAGCAATATA CCCATTAAGGAGTATATAAAGGTGAATTTGATTTACATCAATA AGCGGGGTTGCTGAATCGTTAAGGTAGGCGGTAATAGAAAAGA AATCGAGGCAAAAatgtttgtttaactttaagaaggagatata cat |
| nirB3 SEQ ID NO: 181 | GTCAGCATAACACCCTGACCTCTCATTAATTGCTCATGCCGGA CGGCACTATCGTCGTCCGGCCTTTTCCTCTCTTCCCCCGCTAC GTGCATCTATTTCTATAAACCCGCTCATTTTGTCTATTTTTTG CACAAACATGAAATATCAGACAATTCCGTGACTTAAGAAAATT |

TABLE 21-continued

FNR Promoter sequences

| FNR-responsive regulatory region | 123456789012345678901234567890123456789012345678 90 |
|---|---|
| | TATACAAATCAGCAATATACCCATTAAGGAGTATATAAAGGTG<br>AATTTGATTTACATCAATAAGCGGGGTTGCTGAATCGTTAAGG<br>TAGGCGGTAATAGAAAAGAAATCGAGGCAAAA |
| ydfZ<br>SEQ ID NO:<br>182 | ATTTCCTCTCATCCCATCCGGGGTGAGAGTCTTTTCCCCCGAC<br>TTATGGCTCATGCATGCATCAAAAAAGATGTGAGCTTGATCAA<br>AAACAAAAAATATTTCACTCGACAGGAGTATTTATATTGCGCC<br>CGTTACGTGGGCTTCGACTGTAAATC<u>AGAAAGGAGAAAACACC<br>T</u> |
| nirB + RBS<br>SEQ ID NO:<br>183 | GTCAGCATAACACCCTGACCTCTCATTAATTGTTCATGCCGGG<br>CGGCACTATCGTCGTCCGGCCTTTTCCTCTCTTACTCTGCTAC<br>GTACATCTATTTCTATAAATCCGTTCAATTTGTCTGTTTTTG<br>CACAAACATGAAATATCAGACAATTCCGTGACTTAAGAAAATT<br>TATACAAATCAGCAATATACCCCTTAAGGAGTATATAAAGGTG<br>AATTTGATTTACATCAATAAGCGGGGTTGCTGAATCGTTAAGG<br>ATCCCTCTAGAAATAATTTTGTTTAACTTTAAGAAGGAGATAT<br>ACAT |
| ydfZ + RBS<br>SEQ ID NO:<br>184 | CATTTCCTCTCATCCCATCCGGGGTGAGAGTCTTTTCCCCCGA<br>CTTATGGCTCATGCATGCATCAAAAAAGATGTGAGCTTGATCA<br>AAAACAAAAAATATTTCACTCGACAGGAGTATTTATATTGCGC<br>CCGGATCCCTCTAGAAATAATTTTGTTTAACTTTAAGAAGGAG<br>ATATACAT |
| fnrS1<br>SEQ ID NO:<br>185 | AGTTGTTCTTATTGGTGGTGTTGCTTTATGGTTGCATCGTAGT<br>AAATGGTTGTAACAAAAGCAATTTTTCCGGCTGTCTGTATACA<br>AAAACGCCGTAAAGTTTGAGCGAAGTCAATAAACTCTCTACCC<br>ATTCAGGGCAATATCTCTCTTGGATCCCTCTAGAAATAATTTT<br>GTTTAACTTTAAGAAGGAGATATACAT |
| fnrS2<br>SEQ ID NO:<br>186 | AGTTGTTCTTATTGGTGGTGTTGCTTTATGGTTGCATCGTAGT<br>AAATGGTTGTAACAAAAGCAATTTTTCCGGCTGTCTGTATACA<br>AAAACGCCGCAAAGTTTGAGCGAAGTCAATAAACTCTCTACCC<br>ATTCAGGGCAATATCTCTCTTGGATCCAAAGTGAACTCTAGAA<br>ATAATTTTGTTTAACTTTAAGAAGGAGATATACAT |
| nirB + crp<br>SEQ ID NO:<br>187 | TCGTCTTTGTGATGTGCTTCCTGTTAGGTTTCGTCAGCCGTCA<br>CCGTCAGCATAACACCCTGACCTCTCATTAATTGCTCATGCCG<br>GACGGCACTATCGTCGTCCGGCCTTTTCCTCTCTTCCCCCGCT<br>ACGTGCATCTATTTCTATAAACCCGCTCATTTTGTCTATTTTT<br>TGCACAAACATGAAATATCAGACAATTCCGTGACTTAAGAAAA<br>TTTATACAAATCAGCAATATACCCATTAAGGAGTATATAAAGG<br>TGAATTTGATTTACATCAATAAGCGGGGTTGCTGAATCGTTAA<br>GGTAGaaatgtgatctagttcacatttGCGGTAATAGAAAAGA<br>AATCGAGGCAAAA*atgtttgtttaactttaagaaggagatata<br>cat* |
| fnrS + crp<br>SEQ ID NO:<br>188 | AGTTGTTCTTATTGGTGGTGTTGCTTTATGGTTGCATCGTAGT<br>AAATGGTTGTAACAAAAGCAATTTTTCCGGCTGTCTGTATACA<br>AAAACGCCGCAAAGTTTGAGCGAAGTCAATAAACTCTCTACCC<br>ATTCAGGGCAATATCTCTCaaatgtgatctagttcacattttt<br>*tgtttaactttaagaaggagatatacat* |

In some embodiments, multiple distinct FNR nucleic acid sequences are inserted in the genetically engineered bacteria. In alternate embodiments, the genetically engineered bacteria comprising a gene, gene(s), or gene cassettes for producing the payload(s) is expressed under the control of an alternate oxygen level-dependent promoter, e.g., DNR (Trunk et al., 2010) or ANR (Ray et al., 1997). In alternate embodiments, the genetically engineered bacteria comprising at least one gene, gene(s), or gene cassettes for producing the payload(s) is expressed under the control of an alternate oxygen level-dependent promoter, e.g., DNR (Trunk et al., 2010) or ANR (Ray et al., 1997). In alternate embodiments, the genetically engineered bacteria comprise at least one gene, gene(s), or gene cassettes for producing the payload(s) is expressed under the control of an alternate oxygen level-dependent promoter, e.g., DNR (Trunk et al., 2010) or ANR (Ray et al., 1997). In these embodiments, expression of the payload is particularly activated in a low-oxygen or anaerobic environment, such as in the gut. In some embodiments, gene expression is further optimized by methods known in the art, e.g., by optimizing ribosomal binding sites and/or increasing mRNA stability. In one embodiment, the mammalian gut is a human mammalian gut.

In some embodiments, the bacterial cell comprises an oxygen-level dependent transcriptional regulator, e.g., FNR, ANR, or DNR, and corresponding promoter from a different bacterial species. The heterologous oxygen-level dependent transcriptional regulator and promoter increase the transcription of genes operably linked to said promoter, e.g., the gene, gene(s), or gene cassettes for producing the payload(s) in a low-oxygen or anaerobic environment, as compared to the native gene(s) and promoter in the bacteria under the same conditions. In certain embodiments, the non-native oxygen-level dependent transcriptional regulator is an FNR protein from *N. gonorrhoeae* (see, e.g., Isabella et al., 2011). In some embodiments, the corresponding wild-type transcriptional regulator is left intact and retains wild-type activity. In alternate embodiments, the corresponding wild-type transcriptional regulator is deleted or mutated to reduce or eliminate wild-type activity.

In some embodiments, the genetically engineered bacteria comprise a wild-type oxygen-level dependent transcriptional regulator, e.g., FNR, ANR, or DNR, and corresponding promoter that is mutated relative to the wild-type promoter from bacteria of the same subtype. The mutated promoter enhances binding to the wild-type transcriptional regulator and increases the transcription of genes operably linked to said promoter, as compared to the wild-type promoter under the same conditions. In some embodiments, the genetically engineered bacteria comprise a wild-type oxygen-level dependent promoter, e.g., FNR, ANR, or DNR promoter, and corresponding transcriptional regulator that is mutated relative to the wild-type transcriptional regulator from bacteria of the same subtype. The mutated transcriptional regulator enhances binding to the wild-type promoter and increases the transcription of genes operably linked to said promoter in a low-oxygen or anaerobic environment, as compared to the wild-type transcriptional regulator under the same conditions. In certain embodiments, the mutant oxygen-level dependent transcriptional regulator is an FNR protein comprising amino acid substitutions that enhance dimerization and FNR activity (see, e.g., Moore et al., 2006).

In some embodiments, the bacterial cells disclosed herein comprise multiple copies of the endogenous gene encoding the oxygen level-sensing transcriptional regulator, e.g., the FNR gene. In some embodiments, the gene encoding the oxygen level-sensing transcriptional regulator is present on a plasmid. In some embodiments, the gene encoding the oxygen level-sensing transcriptional regulator and the gene, gene(s), or gene cassettes for producing the payload(s) are present on different plasmids. In some embodiments, the gene encoding the oxygen level-sensing transcriptional regulator and the gene, gene(s), or gene cassettes for producing the payload(s) are present on different plasmids. In some embodiments, the gene encoding the oxygen level-sensing transcriptional regulator and the gene, gene(s), or gene cassettes for producing the payload(s) are present on the same plasmid.

In some embodiments, the gene encoding the oxygen level-sensing transcriptional regulator is present on a chromosome. In some embodiments, the gene encoding the oxygen level-sensing transcriptional regulator and the gene, gene(s), or gene cassettes for producing the payload(s) are present on different chromosomes. In some embodiments, the gene encoding the oxygen level-sensing transcriptional regulator and the gene, gene(s), or gene cassettes for producing the payload(s) are present on the same chromosome. In some instances, it may be advantageous to express the oxygen level-sensing transcriptional regulator under the control of an inducible promoter in order to enhance expression stability. In some embodiments, expression of the transcriptional regulator is controlled by a different promoter than the promoter that controls expression of the gene, gene(s), or gene cassettes for producing the payload(s). In some embodiments, expression of the transcriptional regulator is controlled by the same promoter that controls expression of the gene, gene(s), or gene cassettes for producing the payload(s). In some embodiments, the transcriptional regulator and the payload(s) are divergently transcribed from a promoter region.

RNS-Dependent Regulation

In some embodiments, the genetically engineered bacteria comprise a gene, gene(s), or gene cassettes for producing the payload(s) that is expressed under the control of an inducible promoter. In some embodiments, the genetically engineered bacterium that expresses a gene, gene(s), or gene cassettes for producing the payload(s) is under the control of a promoter that is activated by inflammatory conditions. In one embodiment, the gene, gene(s), or gene cassettes for producing the payload(s) is expressed under the control of an inflammatory-dependent promoter that is activated in inflammatory environments, e.g., a reactive nitrogen species or RNS promoter.

As used herein, "reactive nitrogen species" and "RNS" are used interchangeably to refer to highly active molecules, ions, and/or radicals derived from molecular nitrogen. RNS can cause deleterious cellular effects such as nitrosative stress. RNS includes, but is not limited to, nitric oxide (NO.), peroxynitrite or peroxynitrite anion (ONOO—), nitrogen dioxide (.NO2), dinitrogen trioxide (N2O3), peroxynitrous acid (ONOOH), and nitroperoxycarbonate (ONOOCO2-) (unpaired electrons denoted by •). Bacteria have evolved transcription factors that are capable of sensing RNS levels. Different RNS signaling pathways are triggered by different RNS levels and occur with different kinetics.

As used herein, "RNS-inducible regulatory region" refers to a nucleic acid sequence to which one or more RNS-sensing transcription factors is capable of binding, wherein the binding and/or activation of the corresponding transcription factor activates downstream gene expression; in the presence of RNS, the transcription factor binds to and/or activates the regulatory region. In some embodiments, the RNS-inducible regulatory region comprises a promoter sequence. In some embodiments, the transcription factor senses RNS and subsequently binds to the RNS-inducible regulatory region, thereby activating downstream gene expression. In alternate embodiments, the transcription factor is bound to the RNS-inducible regulatory region in the absence of RNS; in the presence of RNS, the transcription factor undergoes a conformational change, thereby activating downstream gene expression. The RNS-inducible regulatory region may be operatively linked to a gene, gene(s), or gene cassettes for producing the payload(s). For example, in the presence of RNS, a transcription factor senses RNS and activates a corresponding RNS-inducible regulatory region, thereby driving expression of an operatively linked gene sequence. Thus, RNS induces expression of the gene or gene sequences.

As used herein, "RNS-derepressible regulatory region" refers to a nucleic acid sequence to which one or more RNS-sensing transcription factors is capable of binding, wherein the binding of the corresponding transcription factor represses downstream gene expression; in the presence of RNS, the transcription factor does not bind to and does not repress the regulatory region. In some embodiments, the RNS-derepressible regulatory region comprises a promoter sequence. The RNS-derepressible regulatory region may be operatively linked to a gene, gene(s), or gene cassettes for producing the payload(s). For example, in the presence of RNS, a transcription factor senses RNS and no longer binds to and/or represses the regulatory region, thereby derepressing an operatively linked gene sequence or gene cassette. Thus, RNS derepresses expression of the gene or genes.

As used herein, "RNS-repressible regulatory region" refers to a nucleic acid sequence to which one or more RNS-sensing transcription factors is capable of binding, wherein the binding of the corresponding transcription factor represses downstream gene expression; in the presence of RNS, the transcription factor binds to and represses the regulatory region. In some embodiments, the RNS-repressible regulatory region comprises a promoter sequence. In some embodiments, the transcription factor that senses RNS is capable of binding to a regulatory region that overlaps with part of the promoter sequence. In alternate embodiments, the transcription factor that senses RNS is capable of binding to a regulatory region that is upstream or downstream of the promoter sequence. The RNS-repressible regulatory region may be operatively linked to a gene sequence or gene cassette. For example, in the presence of RNS, a transcription factor senses RNS and binds to a corresponding RNS-repressible regulatory region, thereby blocking expression of an operatively linked gene sequence or gene sequences. Thus, RNS represses expression of the gene or gene sequences.

As used herein, a "RNS-responsive regulatory region" refers to a RNS-inducible regulatory region, a RNS-repressible regulatory region, and/or a RNS-derepressible regulatory region. In some embodiments, the RNS-responsive regulatory region comprises a promoter sequence. Each regulatory region is capable of binding at least one corresponding RNS-sensing transcription factor. Examples of transcription factors that sense RNS and their corresponding RNS-responsive genes, promoters, and/or regulatory regions include, but are not limited to, those shown in Table 22.

TABLE 22

Examples of RNS-sensing transcription factors and RNS-responsive genes

| RNS-sensing transcription factor: | Primarily capable of sensing: | Examples of responsive genes, promoters, and/or regulatory regions: |
| --- | --- | --- |
| NsrR | NO | norB, aniA, nsrR, hmpA, ytfE, ygbA, hcp, hcr, nrfA, aox |
| NorR | NO | norVW, norR |
| DNR | NO | norCB, nir, nor, nos |

In some embodiments, the genetically engineered bacteria of the invention comprise a tunable regulatory region that is directly or indirectly controlled by a transcription factor that is capable of sensing at least one reactive nitrogen species. The tunable regulatory region is operatively linked to a gene, gene(s), or gene cassettes for producing the payload(s), thus controlling expression of the payload(s) relative to RNS levels. For example, the tunable regulatory region is a RNS-inducible regulatory region, and the payload is any of the payloads described herein; when RNS is present, e.g., in an inflamed tissue, a RNS-sensing transcription factor binds to and/or activates the regulatory region and drives expression of the payload(s). Subsequently, when inflammation is ameliorated, RNS levels are reduced, and production of the payload(s) is decreased or eliminated.

In some embodiments, the tunable regulatory region is a RNS-inducible regulatory region; in the presence of RNS, a transcription factor senses RNS and activates the RNS-inducible regulatory region, thereby driving expression of an operatively linked gene or genes. In some embodiments, the transcription factor senses RNS and subsequently binds to the RNS-inducible regulatory region, thereby activating downstream gene expression. In alternate embodiments, the transcription factor is bound to the RNS-inducible regulatory region in the absence of RNS; when the transcription factor senses RNS, it undergoes a conformational change, thereby inducing downstream gene expression.

In some embodiments, the tunable regulatory region is a RNS-inducible regulatory region, and the transcription factor that senses RNS is NorR. NorR "is an NO-responsive transcriptional activator that regulates expression of the norVW genes encoding flavorubredoxin and an associated flavoprotein, which reduce NO to nitrous oxide" (Spiro 2006). The genetically engineered bacteria of the invention may comprise any suitable RNS-responsive regulatory region from a gene that is activated by NorR. Genes that are capable of being activated by NorR are known in the art (see, e.g., Spiro 2006; Vine et al., 2011; Karlinsey et al., 2012; Table 1). In certain embodiments, the genetically engineered bacteria of the invention comprise a RNS-inducible regulatory region from norVW that is operatively linked to a gene, gene(s), or gene cassettes for producing the payload(s). In the presence of RNS, a NorR transcription factor senses RNS and activates to the norVW regulatory region, thereby driving expression of the operatively linked gene, gene(s), or gene cassettes and producing the payload(s).

In some embodiments, the tunable regulatory region is a RNS-inducible regulatory region, and the transcription factor that senses RNS is DNR. DNR (dissimilatory nitrate respiration regulator) "promotes the expression of the nir, the nor and the nos genes" in the presence of nitric oxide (Castiglione et al., 2009). The genetically engineered bacteria of the invention may comprise any suitable RNS-responsive regulatory region from a gene that is activated by DNR. Genes that are capable of being activated by DNR are known in the art (see, e.g., Castiglione et al., 2009; Giardina et al., 2008; Table 1). In certain embodiments, the genetically engineered bacteria of the invention comprise a RNS-inducible regulatory region from norCB that is operatively linked to a gene or gene cassette, e.g., a butyrogenic gene cassette. In the presence of RNS, a DNR transcription factor senses RNS and activates to the norCB regulatory region, thereby driving expression of the operatively linked gene or genes and producing one or more amino acid catabolism enzymes. In some embodiments, the DNR is Pseudomonas aeruginosa DNR.

In some embodiments, the tunable regulatory region is a RNS-derepressible regulatory region, and binding of a corresponding transcription factor represses downstream gene expression; in the presence of RNS, the transcription factor no longer binds to the regulatory region, thereby derepressing the operatively linked gene or gene cassette.

In some embodiments, the tunable regulatory region is a RNS-derepressible regulatory region, and the transcription factor that senses RNS is NsrR. NsrR is "an Rrf2-type transcriptional repressor [that] can sense NO and control the expression of genes responsible for NO metabolism" (Isabella et al., 2009). The genetically engineered bacteria of the invention may comprise any suitable RNS-responsive regulatory region from a gene that is repressed by NsrR. In some embodiments, the NsrR is Neisseria gonorrhoeae NsrR. Genes that are capable of being repressed by NsrR are known in the art (see, e.g., Isabella et al., 2009; Dunn et al., 2010; Table 1). In certain embodiments, the genetically engineered bacteria of the invention comprise a RNS-derepressible regulatory region from norB that is operatively linked to a gene or genes. In the presence of RNS, an NsrR transcription factor senses RNS and no longer binds to the norB regulatory region, thereby derepressing the operatively linked gene, gene(s), or gene cassettes for producing the payload(s) and producing the payload(s).

In some embodiments, it is advantageous for the genetically engineered bacteria to express a RNS-sensing transcription factor that does not regulate the expression of a significant number of native genes in the bacteria. In some embodiments, the genetically engineered bacterium of the invention expresses a RNS-sensing transcription factor from a different species, strain, or substrain of bacteria, wherein the transcription factor does not bind to regulatory sequences in the genetically engineered bacterium of the invention. In some embodiments, the genetically engineered bacterium of the invention is *Escherichia coli*, and the RNS-sensing transcription factor is NsrR, e.g., from is *Neisseria gonorrhoeae*, wherein the *Escherichia coli* does not comprise binding sites for said NsrR. In some embodiments, the heterologous transcription factor minimizes or eliminates off-target effects on endogenous regulatory regions and genes in the genetically engineered bacteria.

In some embodiments, the tunable regulatory region is a RNS-repressible regulatory region, and binding of a corresponding transcription factor represses downstream gene expression; in the presence of RNS, the transcription factor senses RNS and binds to the RNS-repressible regulatory region, thereby repressing expression of the operatively linked gene or gene cassette. In some embodiments, the RNS-sensing transcription factor is capable of binding to a regulatory region that overlaps with part of the promoter sequence. In alternate embodiments, the RNS-sensing transcription factor is capable of binding to a regulatory region that is upstream or downstream of the promoter sequence.

In these embodiments, the genetically engineered bacteria may comprise a two repressor activation regulatory circuit, which is used to express an amino acid catabolism enzyme. The two repressor activation regulatory circuit comprises a first RNS-sensing repressor and a second repressor, which is operatively linked to a gene, gene(s), or gene cassettes for producing the payload(s). In one aspect of these embodiments, the RNS-sensing repressor inhibits transcription of the second repressor, which inhibits the transcription of the gene or gene cassette. Examples of second repressors useful in these embodiments include, but are not limited to, TetR, C1, and LexA. In the absence of binding by the first repressor (which occurs in the absence of RNS), the second repressor is transcribed, which represses expression of the gene or genes. In the presence of binding by the first repressor (which occurs in the presence of RNS), expression of the second repressor is repressed, and the gene, gene(s), or gene cassettes for producing the payload(s) is expressed.

A RNS-responsive transcription factor may induce, derepress, or repress gene expression depending upon the regulatory region sequence used in the genetically engineered bacteria. One or more types of RNS-sensing transcription factors and corresponding regulatory region sequences may be present in genetically engineered bacteria. In some embodiments, the genetically engineered bacteria comprise one type of RNS-sensing transcription factor, e.g., NsrR, and one corresponding regulatory region sequence, e.g., from norB. In some embodiments, the genetically engineered bacteria comprise one type of RNS-sensing transcription factor, e.g., NsrR, and two or more different corresponding regulatory region sequences, e.g., from norB and aniA. In some embodiments, the genetically engineered bacteria comprise two or more types of RNS-sensing transcription factors, e.g., NsrR and NorR, and two or more corresponding regulatory region sequences, e.g., from norB and norR, respectively. One RNS-responsive regulatory region may be capable of binding more than one transcription factor. In some embodiments, the genetically engineered bacteria comprise two or more types of RNS-sensing transcription factors and one corresponding regulatory region sequence. Nucleic acid sequences of several RNS-regulated regulatory regions are known in the art (see, e.g., Spiro 2006; Isabella et al., 2009; Dunn et al., 2010; Vine et al., 2011; Karlinsey et al., 2012).

In some embodiments, the genetically engineered bacteria of the invention comprise a gene encoding a RNS-sensing transcription factor, e.g., the nsrR gene, that is controlled by its native promoter, an inducible promoter, a promoter that is stronger than the native promoter, e.g., the GlnRS promoter or the P(Bla) promoter, or a constitutive promoter. In some instances, it may be advantageous to express the RNS-sensing transcription factor under the control of an inducible promoter in order to enhance expression stability. In some embodiments, expression of the RNS-sensing transcription factor is controlled by a different promoter than the promoter that controls expression of the therapeutic molecule. In some embodiments, expression of the RNS-sensing transcription factor is controlled by the same promoter that controls expression of the therapeutic molecule. In some embodiments, the RNS-sensing transcription factor and therapeutic molecule are divergently transcribed from a promoter region.

In some embodiments, the genetically engineered bacteria of the invention comprise a gene for a RNS-sensing transcription factor from a different species, strain, or substrain of bacteria. In some embodiments, the genetically engineered bacteria comprise a RNS-responsive regulatory region from a different species, strain, or substrain of bacteria. In some embodiments, the genetically engineered bacteria comprise a RNS-sensing transcription factor and corresponding RNS-responsive regulatory region from a different species, strain, or substrain of bacteria. The heterologous RNS-sensing transcription factor and regulatory region may increase the transcription of genes operatively linked to said regulatory region in the presence of RNS, as compared to the native transcription factor and regulatory region from bacteria of the same subtype under the same conditions.

In some embodiments, the genetically engineered bacteria comprise a RNS-sensing transcription factor, NsrR, and corresponding regulatory region, nsrR, from *Neisseria gonorrhoeae*. In some embodiments, the native RNS-sensing transcription factor, e.g., NsrR, is left intact and retains wild-type activity. In alternate embodiments, the native RNS-sensing transcription factor, e.g., NsrR, is deleted or mutated to reduce or eliminate wild-type activity.

In some embodiments, the genetically engineered bacteria of the invention comprise multiple copies of the endogenous gene encoding the RNS-sensing transcription factor, e.g., the nsrR gene. In some embodiments, the gene encoding the RNS-sensing transcription factor is present on a plasmid. In some embodiments, the gene encoding the RNS-sensing transcription factor and the gene or gene cassette for producing the therapeutic molecule are present on different plasmids. In some embodiments, the gene encoding the RNS-sensing transcription factor and the gene or gene cassette for producing the therapeutic molecule are present on the same plasmid. In some embodiments, the gene encoding the RNS-sensing transcription factor is present on a chromosome. In some embodiments, the gene encoding the RNS-sensing transcription factor and the gene or gene cassette for producing the therapeutic molecule are present on different chromosomes. In some embodiments, the gene encoding the RNS-sensing transcription factor and the gene or gene cassette for producing the therapeutic molecule are present on the same chromosome.

In some embodiments, the genetically engineered bacteria comprise a wild-type gene encoding a RNS-sensing transcription factor, e.g., the NsrR gene, and a corresponding regulatory region, e.g., a norB regulatory region, that is mutated relative to the wild-type regulatory region from bacteria of the same subtype. The mutated regulatory region increases the expression of the payload(s) the presence of RNS, as compared to the wild-type regulatory region under the same conditions. In some embodiments, the genetically engineered bacteria comprise a wild-type RNS-responsive regulatory region, e.g., the norB regulatory region, and a corresponding transcription factor, e.g., NsrR, that is mutated relative to the wild-type transcription factor from bacteria of the same subtype. The mutant transcription factor increases the expression of the payload(s) in the presence of RNS, as compared to the wild-type transcription factor under the same conditions. In some embodiments, both the RNS-sensing transcription factor and corresponding regulatory region are mutated relative to the wild-type sequences from bacteria of the same subtype in order to increase expression of the payload(s) in the presence of RNS.

In some embodiments, the gene or gene cassette for producing the anti-inflammation and/or gut barrier function enhancer molecule is present on a plasmid and operably linked to a promoter that is induced by RNS. In some embodiments, expression is further optimized by methods known in the art, e.g., by optimizing ribosomal binding sites, manipulating transcriptional regulators, and/or increasing mRNA stability.

In some embodiments, any of the gene(s) of the present disclosure may be integrated into the bacterial chromosome at one or more integration sites. For example, one or more copies of a payload(s) may be integrated into the bacterial chromosome. Having multiple copies of the gene or gen(s) integrated into the chromosome allows for greater production of the amino acid catabolism enzyme(s) and also permits fine-tuning of the level of expression. Alternatively, different circuits described herein, such as any of the secretion or exporter circuits, in addition to the therapeutic gene(s) or gene cassette(s) could be integrated into the bacterial chromosome at one or more different integration sites to perform multiple different functions.

ROS-Dependent Regulation

In some embodiments, the genetically engineered bacteria comprise gene, gene(s), or gene cassettes for producing the payload(s) that is expressed under the control of an inducible promoter. In some embodiments, the genetically engineered bacterium that expresses a payload(s) under the control of a promoter that is activated by conditions of cellular damage. In one embodiment, the gene, gene(s), or gene cassettes for producing the payload(s) is expressed under the control of a cellular damaged-dependent promoter that is activated in environments in which there is cellular or tissue damage, e.g., a reactive oxygen species or ROS promoter.

As used herein, "reactive oxygen species" and "ROS" are used interchangeably to refer to highly active molecules, ions, and/or radicals derived from molecular oxygen. ROS can be produced as byproducts of aerobic respiration or metal-catalyzed oxidation and may cause deleterious cellular effects such as oxidative damage. ROS includes, but is not limited to, hydrogen peroxide ($H_2O_2$), organic peroxide (ROOH), hydroxyl ion (OH—), hydroxyl radical (.OH), superoxide or superoxide anion (.$O_2$-), singlet oxygen ($1O_2$), ozone ($O_3$), carbonate radical, peroxide or peroxyl radical (.$O_2$-2), hypochlorous acid (HOCl), hypochlorite ion (OCl—), sodium hypochlorite (NaOCl), nitric oxide (NO.), and peroxynitrite or peroxynitrite anion (ONOO—) (unpaired electrons denoted by •). Bacteria have evolved transcription factors that are capable of sensing ROS levels. Different ROS signaling pathways are triggered by different ROS levels and occur with different kinetics (Marinho et al., 2014).

As used herein, "ROS-inducible regulatory region" refers to a nucleic acid sequence to which one or more ROS-sensing transcription factors is capable of binding, wherein the binding and/or activation of the corresponding transcription factor activates downstream gene expression; in the presence of ROS, the transcription factor binds to and/or activates the regulatory region. In some embodiments, the ROS-inducible regulatory region comprises a promoter sequence. In some embodiments, the transcription factor senses ROS and subsequently binds to the ROS-inducible regulatory region, thereby activating downstream gene expression. In alternate embodiments, the transcription factor is bound to the ROS-inducible regulatory region in the absence of ROS; in the presence of ROS, the transcription factor undergoes a conformational change, thereby activating downstream gene expression. The ROS-inducible regulatory region may be operatively linked to a gene, gene(s), or gene cassettes for producing the payload(s). For example, in the presence of ROS, a transcription factor, e.g., OxyR, senses ROS and activates a corresponding ROS-inducible regulatory region, thereby driving expression of an operatively linked gene sequence or gene sequences. Thus, ROS induces expression of the gene or genes.

As used herein, "ROS-derepressible regulatory region" refers to a nucleic acid sequence to which one or more ROS-sensing transcription factors is capable of binding, wherein the binding of the corresponding transcription factor represses downstream gene expression; in the presence of ROS, the transcription factor does not bind to and does not repress the regulatory region. In some embodiments, the ROS-derepressible regulatory region comprises a promoter sequence. The ROS-derepressible regulatory region may be operatively linked to a gene, gene(s), or gene cassettes for producing the payload(s). For example, in the presence of ROS, a transcription factor, e.g., OhrR, senses ROS and no longer binds to and/or represses the regulatory region, thereby derepressing an operatively linked gene sequence or gene cassette. Thus, ROS derepresses expression of the gene or gene cassette.

As used herein, "ROS-repressible regulatory region" refers to a nucleic acid sequence to which one or more ROS-sensing transcription factors is capable of binding, wherein the binding of the corresponding transcription factor represses downstream gene expression; in the presence of ROS, the transcription factor binds to and represses the regulatory region. In some embodiments, the ROS-repressible regulatory region comprises a promoter sequence. In some embodiments, the transcription factor that senses ROS is capable of binding to a regulatory region that overlaps with part of the promoter sequence. In alternate embodiments, the transcription factor that senses ROS is capable of binding to a regulatory region that is upstream or downstream of the promoter sequence. The ROS-repressible regulatory region may be operatively linked to a gene sequence or gene sequences. For example, in the presence of ROS, a transcription factor, e.g., PerR, senses ROS and binds to a corresponding ROS-repressible regulatory region, thereby blocking expression of an operatively linked gene sequence or gene sequences. Thus, ROS represses expression of the gene or genes.

As used herein, a "ROS-responsive regulatory region" refers to a ROS-inducible regulatory region, a ROS-repressible regulatory region, and/or a ROS-derepressible regulatory region. In some embodiments, the ROS-responsive regulatory region comprises a promoter sequence. Each regulatory region is capable of binding at least one corresponding ROS-sensing transcription factor. Examples of transcription factors that sense ROS and their corresponding ROS-responsive genes, promoters, and/or regulatory regions include, but are not limited to, those shown in Table 23.

TABLE 23

Examples of ROS-sensing transcription factors and ROS-responsive genes

| ROS-sensing transcription factor: | Primarily capable of sensing: | Examples of responsive genes, promoters, and/or regulatory regions: |
|---|---|---|
| OxyR | $H_2O_2$ | ahpC; ahpF; dps; dsbG; fhuF; flu; fur; gor; grxA; hemH; katG; oxyS; sufA; sufB; sufC; sufD; sufE; sufS; trxC; uxuA; yaaA; yaeH; yaiA; ybjM; ydcH; ydeN; ygaQ; yljA; ytfK |
| PerR | $H_2O_2$ | katA; ahpCF; mrgA; zoaA; fur; hemAXCDBL; srfA |
| OhrR | Organic peroxides NaOCl | ohrA |
| SoxR | $\cdot O_2^-$ NO• (also capable of sensing $H_2O_2$) | soxS |
| RosR | $H_2O_2$ | rbtT; tnpl6a; rluCl; tnp5a; mscL; tnp2d; phoD; tnpl5b; pstA; tnp5b; xylC; gabD1; rluC2; cgtS9; az1C; narKGHJI; rosR |

In some embodiments, the genetically engineered bacteria comprise a tunable regulatory region that is directly or indirectly controlled by a transcription factor that is capable of sensing at least one reactive oxygen species. The tunable regulatory region is operatively linked to a gene or gene cassette capable of directly or indirectly driving the expression of an amino acid catabolism enzyme, thus controlling expression of the payload(s) relative to ROS levels. For example, the tunable regulatory region is a ROS-inducible regulatory region, and the molecule is an payload; when ROS is present, e.g., in an inflamed tissue, a ROS-sensing transcription factor binds to and/or activates the regulatory region and drives expression of the gene sequence for the payload(s) thereby producing the payload(s). Subsequently, when inflammation is ameliorated, ROS levels are reduced, and production of the payload(s) is decreased or eliminated.

In some embodiments, the tunable regulatory region is a ROS-inducible regulatory region; in the presence of ROS, a transcription factor senses ROS and activates the ROS-inducible regulatory region, thereby driving expression of an operatively linked gene or gene cassette. In some embodiments, the transcription factor senses ROS and subsequently binds to the ROS-inducible regulatory region, thereby activating downstream gene expression. In alternate embodiments, the transcription factor is bound to the ROS-inducible regulatory region in the absence of ROS; when the transcription factor senses ROS, it undergoes a conformational change, thereby inducing downstream gene expression.

In some embodiments, the tunable regulatory region is a ROS-inducible regulatory region, and the transcription factor that senses ROS is OxyR. OxyR "functions primarily as a global regulator of the peroxide stress response" and is capable of regulating dozens of genes, e.g., "genes involved in H2O2 detoxification (katE, ahpCF), heme biosynthesis (hemH), reductant supply (grxA, gor, trxC), thiol-disulfide isomerization (dsbG), Fe—S center repair (sufA-E, sufS), iron binding (yaaA), repression of iron import systems (fur)" and "OxyS, a small regulatory RNA" (Dubbs et al., 2012). The genetically engineered bacteria may comprise any suitable ROS-responsive regulatory region from a gene that is activated by OxyR. Genes that are capable of being activated by OxyR are known in the art (see, e.g., Zheng et al., 2001; Dubbs et al., 2012; Table 1). In certain embodiments, the genetically engineered bacteria of the invention comprise a ROS-inducible regulatory region from oxyS that is operatively linked to a gene, gene(s), or gene cassettes for producing the payload(s). In the presence of ROS, e.g., H2O2, an OxyR transcription factor senses ROS and activates to the oxyS regulatory region, thereby driving expression of the operatively linked payload(s) and producing the payload(s). In some embodiments, OxyR is encoded by an E. coli oxyR gene. In some embodiments, the oxyS regulatory region is an E. coli oxyS regulatory region. In some embodiments, the ROS-inducible regulatory region is selected from the regulatory region of katG, dps, and ahpC.

In alternate embodiments, the tunable regulatory region is a ROS-inducible regulatory region, and the corresponding transcription factor that senses ROS is SoxR. When SoxR is "activated by oxidation of its [2Fe-2S] cluster, it increases the synthesis of SoxS, which then activates its target gene expression" (Koo et al., 2003). "SoxR is known to respond primarily to superoxide and nitric oxide" (Koo et al., 2003), and is also capable of responding to H2O2. The genetically engineered bacteria of the invention may comprise any suitable ROS-responsive regulatory region from a gene that is activated by SoxR. Genes that are capable of being activated by SoxR are known in the art (see, e.g., Koo et al., 2003; Table 1). In certain embodiments, the genetically engineered bacteria of the invention comprise a ROS-inducible regulatory region from soxS that is operatively linked to a gene. In the presence of ROS, the SoxR transcription factor senses ROS and activates the soxS regulatory region, thereby driving expression of the operatively linked gene, gene(s), or gene cassettes for producing the payload(s) and producing the payload(s).

In some embodiments, the tunable regulatory region is a ROS-derepressible regulatory region, and binding of a corresponding transcription factor represses downstream gene expression; in the presence of ROS, the transcription factor no longer binds to the regulatory region, thereby derepressing the operatively linked gene or gene cassette.

In some embodiments, the tunable regulatory region is a ROS-derepressible regulatory region, and the transcription factor that senses ROS is OhrR. OhrR "binds to a pair of inverted repeat DNA sequences overlapping the ohrA promoter site and thereby represses the transcription event," but oxidized OhrR is "unable to bind its DNA target" (Duarte et al., 2010). OhrR is a "transcriptional repressor [that] . . .

senses both organic peroxides and NaOCl" (Dubbs et al., 2012) and is "weakly activated by H2O2 but it shows much higher reactivity for organic hydroperoxides" (Duarte et al., 2010). The genetically engineered bacteria of the invention may comprise any suitable ROS-responsive regulatory region from a gene that is repressed by OhrR. Genes that are capable of being repressed by OhrR are known in the art (see, e.g., Dubbs et al., 2012; Table 1). In certain embodiments, the genetically engineered bacteria of the invention comprise a ROS-derepressible regulatory region from ohrA that is operatively linked to a gene or gene cassette. In the presence of ROS, e.g., NaOCl, an OhrR transcription factor senses ROS and no longer binds to the ohrA regulatory region, thereby derepressing the operatively linked gene, gene(s), or gene cassettes for producing the payload(s) and producing the payload(s).

OhrR is a member of the MarR family of ROS-responsive regulators. "Most members of the MarR family are transcriptional repressors and often bind to the −10 or −35 region in the promoter causing a steric inhibition of RNA polymerase binding" (Bussmann et al., 2010). Other members of this family are known in the art and include, but are not limited to, OspR, MgrA, RosR, and SarZ. In some embodiments, the transcription factor that senses ROS is OspR, MgRA, RosR, and/or SarZ, and the genetically engineered bacteria of the invention comprises one or more corresponding regulatory region sequences from a gene that is repressed by OspR, MgRA, RosR, and/or SarZ. Genes that are capable of being repressed by OspR, MgRA, RosR, and/or SarZ are known in the art (see, e.g., Dubbs et al., 2012).

In some embodiments, the tunable regulatory region is a ROS-derepressible regulatory region, and the corresponding transcription factor that senses ROS is RosR. RosR is "a MarR-type transcriptional regulator" that binds to an "18-bp inverted repeat with the consensus sequence TTGTTGAY-RYRTCAACWA" and is "reversibly inhibited by the oxidant H2O2" (Bussmann et al., 2010). RosR is capable of repressing numerous genes and putative genes, including but not limited to "a putative polyisoprenoid-binding protein (cg1322, gene upstream of and divergent from rosR), a sensory histidine kinase (cgtS9), a putative transcriptional regulator of the Crp/FNR family (cg3291), a protein of the glutathione S-transferase family (cg1426), two putative FMN reductases (cg1150 and cg1850), and four putative monooxygenases (cg0823, cg1848, cg2329, and cg3084)" (Bussmann et al., 2010). The genetically engineered bacteria of the invention may comprise any suitable ROS-responsive regulatory region from a gene that is repressed by RosR. Genes that are capable of being repressed by RosR are known in the art (see, e.g., Bussmann et al., 2010; Table 1). In certain embodiments, the genetically engineered bacteria of the invention comprise a ROS-derepressible regulatory region from cgtS9 that is operatively linked to a gene or gene cassette. In the presence of ROS, e.g., H2O2, a RosR transcription factor senses ROS and no longer binds to the cgtS9 regulatory region, thereby derepressing the operatively linked gene, gene(s), or gene cassettes for producing the payload(s) and producing the payload(s).

In some embodiments, it is advantageous for the genetically engineered bacteria to express a ROS-sensing transcription factor that does not regulate the expression of a significant number of native genes in the bacteria. In some embodiments, the genetically engineered bacterium of the invention expresses a ROS-sensing transcription factor from a different species, strain, or substrain of bacteria, wherein the transcription factor does not bind to regulatory sequences in the genetically engineered bacterium of the invention. In some embodiments, the genetically engineered bacterium of the invention is *Escherichia coli*, and the ROS-sensing transcription factor is RosR, e.g., from *Corynebacterium glutamicum*, wherein the *Escherichia coli* does not comprise binding sites for said RosR. In some embodiments, the heterologous transcription factor minimizes or eliminates off-target effects on endogenous regulatory regions and genes in the genetically engineered bacteria.

In some embodiments, the tunable regulatory region is a ROS-repressible regulatory region, and binding of a corresponding transcription factor represses downstream gene expression; in the presence of ROS, the transcription factor senses ROS and binds to the ROS-repressible regulatory region, thereby repressing expression of the operatively linked gene or gene cassette. In some embodiments, the ROS-sensing transcription factor is capable of binding to a regulatory region that overlaps with part of the promoter sequence. In alternate embodiments, the ROS-sensing transcription factor is capable of binding to a regulatory region that is upstream or downstream of the promoter sequence.

In some embodiments, the tunable regulatory region is a ROS-repressible regulatory region, and the transcription factor that senses ROS is PerR. In *Bacillus subtilis*, PerR "when bound to DNA, represses the genes coding for proteins involved in the oxidative stress response (katA, ahpC, and mrgA), metal homeostasis (hemAXCDBL, fur, and zoaA) and its own synthesis (perR)" (Marinho et al., 2014). PerR is a "global regulator that responds primarily to H2O2" (Dubbs et al., 2012) and "interacts with DNA at the per box, a specific palindromic consensus sequence (TTATAATNATTATAA) residing within and near the promoter sequences of PerR-controlled genes" (Marinho et al., 2014). PerR is capable of binding a regulatory region that "overlaps part of the promoter or is immediately downstream from it" (Dubbs et al., 2012). The genetically engineered bacteria of the invention may comprise any suitable ROS-responsive regulatory region from a gene that is repressed by PerR. Genes that are capable of being repressed by PerR are known in the art (see, e.g., Dubbs et al., 2012; Table 1).

In these embodiments, the genetically engineered bacteria may comprise a two repressor activation regulatory circuit, which is used to express an amino acid catabolism enzyme. The two repressor activation regulatory circuit comprises a first ROS-sensing repressor, e.g., PerR, and a second repressor, e.g., TetR, which is operatively linked to a gene or gene cassette, e.g., an amino acid catabolism enzyme. In one aspect of these embodiments, the ROS-sensing repressor inhibits transcription of the second repressor, which inhibits the transcription of the gene or gene cassette. Examples of second repressors useful in these embodiments include, but are not limited to, TetR, C1, and LexA. In some embodiments, the ROS-sensing repressor is PerR. In some embodiments, the second repressor is TetR. In this embodiment, a PerR-repressible regulatory region drives expression of TetR, and a TetR-repressible regulatory region drives expression of the gene or gene cassette, e.g., an amino acid catabolism enzyme. In the absence of PerR binding (which occurs in the absence of ROS), tetR is transcribed, and TetR represses expression of the gene or gene cassette, e.g., an amino acid catabolism enzyme. In the presence of PerR binding (which occurs in the presence of ROS), tetR expression is repressed, and the gene or gene cassette is expressed.

A ROS-responsive transcription factor may induce, derepress, or repress gene expression depending upon the regulatory region sequence used in the genetically engineered bacteria. For example, although "OxyR is primarily thought of as a transcriptional activator under oxidizing conditions . . . OxyR can function as either a repressor or activator under both oxidizing and reducing conditions" (Dubbs et al., 2012), and OxyR "has been shown to be a repressor of its own expression as well as that of fhuF (encoding a ferric ion reductase) and flu (encoding the antigen 43 outer membrane protein)" (Zheng et al., 2001). The genetically engineered bacteria of the invention may comprise any suitable ROS-responsive regulatory region from a gene that is repressed by OxyR. In some embodiments, OxyR is used in a two repressor activation regulatory circuit, as described above. Genes that are capable of being repressed by OxyR are known in the art (see, e.g., Zheng et al., 2001; Table 1). Or, for example, although RosR is capable of repressing a number of genes, it is also capable of activating certain genes, e.g., the narKGHJI operon. In some embodiments, the genetically engineered bacteria comprise any suitable ROS-responsive regulatory region from a gene that is activated by RosR. In addition, "PerR-mediated positive regulation has also been observed . . . and appears to involve PerR binding to distant upstream sites" (Dubbs et al., 2012). In some embodiments, the genetically engineered bacteria comprise any suitable ROS-responsive regulatory region from a gene that is activated by PerR.

(Dubbs et al., 2012). In some embodiments, the genetically engineered bacteria comprise one type of ROS-sensing transcription factor, e.g., OxyR, and one corresponding regulatory region sequence, e.g., from oxyS. In some embodiments, the genetically engineered bacteria comprise one type of ROS-sensing transcription factor, e.g., OxyR, and two or more different corresponding regulatory region sequences, e.g., from oxyS and katG. In some embodiments, the genetically engineered bacteria comprise two or more types of ROS-sensing transcription factors, e.g., OxyR and PerR, and two or more corresponding regulatory region sequences, e.g., from oxyS and katA, respectively. One ROS-responsive regulatory region may be capable of binding more than one transcription factor. In some embodiments, the genetically engineered bacteria comprise two or more types of ROS-sensing transcription factors and one corresponding regulatory region sequence.

Nucleic acid sequences of several exemplary OxyR-regulated regulatory regions are shown in Table 24. OxyR binding sites are underlined and bolded. In some embodiments, genetically engineered bacteria comprise a nucleic acid sequence that is at least about 80%, at least about 85%, at least about 90%, at least about 95%, or at least about 99% homologous to the DNA sequence of SEQ ID NO: 189, 190, 191, or 192, or a functional fragment thereof.

TABLE 24

Nucleotide sequences of exemplary OxyR-regulated regulatory regions

| Regulatory sequence | 0123456789012345678901234567890123456789012345678 |
|---|---|
| katG (SEQ ID NO: 189) | TGTGGCTTTTATGAAAATCACACAGTGATCACAAATTTT<br>AAACAGAGCACAAAATGCTGCCTCGAAATGAGGGCGG<br>GAAAATAAGGTTATCAGCCTTGTTTTCTCCCTCATTACT<br>TGAAGGATATGAAGCTAAAACCCTTTTTTATAAAGCATT<br>TGTCCGAATTCGGACATAATCAAAAAAGCTTAATTAAG<br>ATCAATTTGATCTACATCTCTTTAACCAACAATATGTAA<br>GATCTCAACTATCGCATCCGTGGATTAATTCAATTAT<br>AACTTCTCTCTAACGCTGTGTATCGTAACGGTAACACTG<br>TAGAGGGGAGCACATTGATGCGAATTCATTAAAGAGGA<br>GAAAGGTACC |
| dps (SEQ ID NO: 190) | TTCCGAAAATTCCTGGCGAGCAGATAAATAAGAATTGT<br>TCTTATCAATATATCTAACTCATTGAATCTTTATTAGTTT<br>TGTTTTTCACGCTTGTTACCACTATTAGTGTGATAGGA<br>ACAGCCAGAATAGCGGAACACATAGCCGGTGCTATAC<br>TTAATCTCGTTAATTACTGGGACATAACATCAAGAGGA<br>TATGAAATTCGAATTCATTAAAGAGGAGAAAGGTACC |
| ahpC (SEQ ID NO: 191) | GCTTAGATCAGGTGATTGCCCTTTGTTTATGAGGGTGTT<br>GTAATCCATGTCGTTGTTGCATTTGTAAGGGCAACACCT<br>CAGCCTGCAGGCAGGCACTGAAGATACCAAAGGGTAGT<br>TCAGATTACACGGTCACCTGGAAAGGGGGCCATTTTAC<br>TTTTTATCGCCGCTGGCGGTGCAAAGTTCACAAAGTTGT<br>CTTACGAAGGTTGTAAGGTAAAACTTATCGATTTGATA<br>ATGGAAACGCATTAGCCGAATCGGCAAAAATTGGTTA<br>CCTTACATCTCATCGAAAACACGGAGGAAGTATAGATG<br>CGAATTCATTAAAGAGGAGAAAGGTACC |
| oxyS (SEQ ID NO: 192) | CTCGAGTTCATTATCCATCCTCCATCGCCACGATAGTTC<br>ATGGCGATAGGTAGAATAGCAATGAACGATTATCCCT<br>ATCAAGCATTCTGACTGATAATTGCTCACACGAATTCAT<br>TAAAGAGGAGAAAGGTACC |

One or more types of ROS-sensing transcription factors and corresponding regulatory region sequences may be present in genetically engineered bacteria. For example, "OhrR is found in both Gram-positive and Gram-negative bacteria and can coreside with either OxyR or PerR or both"

In some embodiments, the genetically engineered bacteria of the invention comprise a gene encoding a ROS-sensing transcription factor, e.g., the oxyR gene, that is controlled by its native promoter, an inducible promoter, a promoter that is stronger than the native promoter, e.g., the GlnRS promoter or the P(Bla) promoter, or a constitutive promoter. In some instances, it may be advantageous to express the ROS-sensing transcription factor under the control of an inducible promoter in order to enhance expression stability. In some embodiments, expression of the ROS-sensing transcription factor is controlled by a different promoter than the promoter that controls expression of the therapeutic molecule. In some embodiments, expression of the ROS-sensing transcription factor is controlled by the same promoter that controls expression of the therapeutic molecule. In some embodiments, the ROS-sensing transcription factor and therapeutic molecule are divergently transcribed from a promoter region.

In some embodiments, the genetically engineered bacteria of the invention comprise a gene for a ROS-sensing transcription factor from a different species, strain, or substrain of bacteria. In some embodiments, the genetically engineered bacteria comprise a ROS-responsive regulatory region from a different species, strain, or substrain of bacteria. In some embodiments, the genetically engineered bacteria comprise a ROS-sensing transcription factor and corresponding ROS-responsive regulatory region from a different species, strain, or substrain of bacteria. The heterologous ROS-sensing transcription factor and regulatory region may increase the transcription of genes operatively linked to said regulatory region in the presence of ROS, as compared to the native transcription factor and regulatory region from bacteria of the same subtype under the same conditions.

In some embodiments, the genetically engineered bacteria comprise a ROS-sensing transcription factor, OxyR, and corresponding regulatory region, oxyS, from *Escherichia coli*. In some embodiments, the native ROS-sensing transcription factor, e.g., OxyR, is left intact and retains wild-type activity. In alternate embodiments, the native ROS-sensing transcription factor, e.g., OxyR, is deleted or mutated to reduce or eliminate wild-type activity.

In some embodiments, the genetically engineered bacteria of the invention comprise multiple copies of the endogenous gene encoding the ROS-sensing transcription factor, e.g., the oxyR gene. In some embodiments, the gene encoding the ROS-sensing transcription factor is present on a plasmid. In some embodiments, the gene encoding the ROS-sensing transcription factor and the gene or gene cassette for producing the therapeutic molecule are present on different plasmids. In some embodiments, the gene encoding the ROS-sensing transcription factor and the gene or gene cassette for producing the therapeutic molecule are present on the same. In some embodiments, the gene encoding the ROS-sensing transcription factor is present on a chromosome. In some embodiments, the gene encoding the ROS-sensing transcription factor and the gene or gene cassette for producing the therapeutic molecule are present on different chromosomes. In some embodiments, the gene encoding the ROS-sensing transcription factor and the gene or gene cassette for producing the therapeutic molecule are present on the same chromosome.

In some embodiments, the genetically engineered bacteria comprise a wild-type gene encoding a ROS-sensing transcription factor, e.g., the soxR gene, and a corresponding regulatory region, e.g., a soxS regulatory region, that is mutated relative to the wild-type regulatory region from bacteria of the same subtype. The mutated regulatory region increases the expression of the gene, gene(s), or gene cassettes for producing the payload(s) in the presence of ROS, as compared to the wild-type regulatory region under the same conditions. In some embodiments, the genetically engineered bacteria comprise a wild-type ROS-responsive regulatory region, e.g., the oxyS regulatory region, and a corresponding transcription factor, e.g., OxyR, that is mutated relative to the wild-type transcription factor from bacteria of the same subtype. The mutant transcription factor increases the expression of the gene, gene(s), or gene cassettes for producing the payload(s) in the presence of ROS, as compared to the wild-type transcription factor under the same conditions. In some embodiments, both the ROS-sensing transcription factor and corresponding regulatory region are mutated relative to the wild-type sequences from bacteria of the same subtype in order to increase expression of the payload(s) in the presence of ROS.

In some embodiments, the gene, gene(s), or gene cassettes for producing the payload(s) is present on a plasmid and operably linked to a promoter that is induced by ROS. In some embodiments, the gene, gene(s), or gene cassettes for producing the payload(s) is present in the chromosome and operably linked to a promoter that is induced by ROS. In some embodiments, the gene, gene(s), or gene cassettes for producing the payload(s) is present on a chromosome and operably linked to a promoter that is induced by exposure to tetracycline. In some embodiments, the gene, gene(s), or gene cassettes for producing the payload(s) is present on a plasmid and operably linked to a promoter that is induced by exposure to tetracycline. In some embodiments, expression is further optimized by methods known in the art, e.g., by optimizing ribosomal binding sites, manipulating transcriptional regulators, and/or increasing mRNA stability.

In some embodiments, the genetically engineered bacteria may comprise multiple copies of the gene, gene(s), or gene cassettes for producing the payload(s). In some embodiments, the gene, gene(s), or gene cassettes for producing the payload(s) is present on a plasmid and operatively linked to a ROS-responsive regulatory region. In some embodiments, the gene, gene(s), or gene cassettes for producing the payload(s) is present in a chromosome and operatively linked to a ROS-responsive regulatory region.

Thus, in some embodiments, the genetically engineered bacteria or genetically engineered virus produce one or more amino acid catabolism enzymes under the control of an oxygen level-dependent promoter, a reactive oxygen species (ROS)-dependent promoter, or a reactive nitrogen species (RNS)-dependent promoter, and a corresponding transcription factor.

In some embodiments, the genetically engineered bacteria comprise a stably maintained plasmid or chromosome carrying a gene, gene(s), or gene cassettes for producing the payload(s) such that the gene, gene(s), or gene cassettes for producing the payload(s) can be expressed in the host cell, and the host cell is capable of survival and/or growth in vitro, e.g., in medium, and/or in vivo. In some embodiments, a bacterium may comprise multiple copies of the gene, gene(s), or gene cassettes for producing the payload(s). In some embodiments, the gene, gene(s), or gene cassettes for producing the payload(s) is expressed on a low-copy plasmid. In some embodiments, the low-copy plasmid may be useful for increasing stability of expression. In some embodiments, the low-copy plasmid may be useful for decreasing leaky expression under non-inducing conditions. In some embodiments, the gene, gene(s), or gene cassettes for producing the payload(s) is expressed on a high-copy plasmid. In some embodiments, the high-copy plasmid may be useful for increasing expression of the gene, gene(s), or gene cassettes for producing the payload(s). In some embodiments, the gene, gene(s), or gene cassettes for producing the payload(s) is expressed on a chromosome.

Regulation of Expression

The genetically engineered bacteria of the invention comprise a gene or gene cassette for producing a metabolic and/or satiety effector molecule, wherein the gene or gene cassette is operably linked to a directly or indirectly inducible promoter that is controlled by exogenous environmental condition(s). In some embodiments, the inducible promoter is an oxygen level-dependent promoter and the metabolic and/or satiety effector molecule is expressed in low-oxygen, microaerobic, or anaerobic conditions. For example, in low oxygen conditions, the oxygen level-dependent promoter is activated by a corresponding oxygen level-sensing transcription factor, thereby driving production of the metabolic and/or satiety effector molecule.

Bacteria have evolved transcription factors that are capable of sensing oxygen levels. Different signaling pathways may be triggered by different oxygen levels and occur with different kinetics. An oxygen level-dependent promoter is a nucleic acid sequence to which one or more oxygen level-sensing transcription factors is capable of binding, wherein the binding and/or activation of the corresponding transcription factor activates downstream gene expression. In one embodiment, the genetically engineered bacteria comprise a gene or gene cassette for producing a payload under the control of an oxygen level-dependent promoter. In a more specific aspect, the genetically engineered bacteria comprise a gene or gene cassette for producing a payload under the control of an oxygen level-dependent promoter that is activated under low-oxygen or anaerobic environments, such as the environment of the mammalian gut.

In certain embodiments, the genetically engineered bacteria comprise the gene or gene cassette for producing the metabolic and/or satiety effector molecule expressed under the control of the fumarate and nitrate reductase regulator (FNR). In *E. coli*, FNR is a major transcriptional activator that controls the switch from aerobic to anaerobic metabolism (Unden et al., 1997). In the anaerobic state, FNR dimerizes into an active DNA binding protein that activates hundreds of genes responsible for adapting to anaerobic growth. In the aerobic state, FNR is prevented from dimerizing by oxygen and is inactive. In alternate embodiments, the genetically engineered bacteria comprise a gene or gene cassette for producing the metabolic and/or satiety effector molecule expressed under the control of an alternate oxygen level-dependent promoter, e.g., an anaerobic regulation of arginine deiminiase and nitrate reduction ANR promoter (Ray et al., 1997), a dissimilatory nitrate respiration regulator DNR promoter (Trunk et al., 2010). In these embodiments, expression of the payload is particularly activated in a low-oxygen or anaerobic environment, such as in the gut.

In another embodiment, the genetically engineered bacteria comprise the gene or gene cassette for producing the metabolic and/or satiety effector molecule expressed under the control of anaerobic regulation of arginine deiminiase and nitrate reduction transcriptional regulator (ANR). In *P. aeruginosa*, ANR is "required for the expression of physiological functions which are inducible under oxygen-limiting or anaerobic conditions" (Winteler et al., 1996; Sawers 1991). *P. aeruginosa* ANR is homologous with *E. coli* FNR, and "the consensus FNR site (TTGAT----ATCAA) was recognized efficiently by ANR and FNR" (Winteler et al., 1996). Like FNR, in the anaerobic state, ANR activates numerous genes responsible for adapting to anaerobic growth. In the aerobic state, ANR is inactive. *Pseudomonas fluorescens*, *Pseudomonas putida*, *Pseudomonas syringae*, and *Pseudomonas mendocina* all have functional analogs of ANR (Zimmermann et al., 1991). Promoters that are regulated by ANR are known in the art, e.g., the promoter of the arcDABC operon (see, e.g., Hasegawa et al., 1998).

In another embodiment, the genetically engineered bacteria comprise the gene or gene cassette for producing the metabolic and/or satiety effector molecule expressed under the control of the dissimilatory nitrate respiration regulator (DNR). DNR is a member of the FNR family (Arai et al., 1995) and is a transcriptional regulator that is required in conjunction with ANR for "anaerobic nitrate respiration of *Pseudomonas aeruginosa*" (Hasegawa et al., 1998). For certain genes, the FNR-binding motifs "are probably recognized only by DNR" (Hasegawa et al., 1998). Any suitable transcriptional regulator that is controlled by exogenous environmental conditions and corresponding regulatory region may be used. Non-limiting examples include ArcA/B, ResD/E, NreA/B/C, and AirSR, and others are known in the art.

In some embodiments, the genetically engineered bacteria comprise the gene or gene cassette for producing the metabolic and/or satiety effector molecule expressed under the control of an inducible promoter that is responsive to specific molecules or metabolites in the environment, e.g., the mammalian gut. For example, the short-chain fatty acid propionate is a major microbial fermentation metabolite localized to the gut (Hosseini et al., 2011). In one embodiment, the gene or gene cassette for producing the metabolic and/or satiety effector molecule is under the control of a propionate-inducible promoter. In a more specific embodiment, the gene or gene cassette for producing the metabolic and/or satiety effector molecule is under the control of a propionate-inducible promoter that is activated by the presence of propionate in the mammalian gut. Any molecule or metabolite found in the mammalian gut, in a healthy and/or disease state, may be used to induce payload expression. Non-limiting examples of inducers include propionate, bilirubin, aspartate aminotransferase, alanine aminotransferase, blood coagulation factors II, VII, IX, and X, alkaline phosphatase, gamma glutamyl transferase, hepatitis antigens and antibodies, alpha fetoprotein, anti-mitochondrial, smooth muscle, and anti-nuclear antibodies, iron, transferrin, ferritin, copper, ceruloplasmin, ammonia, and manganese. In alternate embodiments, the gene or gene cassette for producing the metabolic and/or satiety effector molecule is under the control of a pBAD promoter, which is activated in the presence of the sugar arabinose.

In some embodiments, the gene or gene cassette for producing the metabolic and/or satiety effector molecule is present on a plasmid and operably linked to a promoter that is induced under low-oxygen or anaerobic conditions. In some embodiments, the gene or gene cassette for producing the metabolic and/or satiety effector molecule is present in the chromosome and operably linked to a promoter that is induced under low-oxygen or anaerobic conditions. In some embodiments, the gene or gene cassette for producing the metabolic and/or satiety effector molecule is present on a plasmid and operably linked to a promoter that is induced by molecules or metabolites that are specific to the mammalian gut. In some embodiments, the gene or gene cassette for producing the metabolic and/or satiety effector molecule is present on a chromosome and operably linked to a promoter that is induced by molecules or metabolites that are specific to the mammalian gut. In some embodiments, the gene or gene cassette for producing the metabolic and/or satiety effector molecule is present on a chromosome and operably linked to a promoter that is induced by exposure to tetracycline. In some embodiments, the gene or gene cassette for producing the metabolic and/or satiety effector molecule is present on a plasmid and operably linked to a promoter that is induced by exposure to tetracycline. In some embodiments, expression is further optimized by methods known in the art, e.g., by optimizing ribosomal binding sites, manipulating transcriptional regulators, and/or increasing mRNA stability.

In some embodiments, the genetically engineered bacteria comprise a variant or mutated oxygen level-dependent transcriptional regulator, e.g., FNR, ANR, or DNR, in addition to the corresponding oxygen level-dependent promoter. The variant or mutated oxygen level-dependent transcriptional regulator increases the transcription of operably linked genes in a low-oxygen or anaerobic environment. In some embodiments, the corresponding wild-type transcriptional regulator retains wild-type activity. In alternate embodiments, the corresponding wild-type transcriptional regulator is deleted or mutated to reduce or eliminate wild-type activity. In certain embodiments, the mutant oxygen level-dependent transcriptional regulator is a FNR protein comprising amino acid substitutions that enhance dimerization and FNR activity (see, e.g., Moore et al., 2006).

In some embodiments, the genetically engineered bacteria comprise an oxygen level-dependent transcriptional regulator from a different bacterial species. In certain embodiments, the mutant oxygen level-dependent transcriptional regulator is a FNR protein from *N. gonorrhoeae* (see, e.g., Isabella et al., 2011). In some embodiments, the corresponding wild-type transcriptional regulator is left intact and retains wild-type activity. In alternate embodiments, the corresponding wild-type transcriptional regulator is deleted or mutated to reduce or eliminate wild-type activity.

In some embodiments, the genetically engineered bacteria express the gene or gene cassette for producing the metabolic and/or satiety molecule on a plasmid and/or a chromosome. In some embodiments, the gene or gene cassette is expressed under the control of a constitutive promoter. In some embodiments, the gene or gene cassette is expressed under the control of an inducible promoter. In one embodiment, the gene or gene cassette is expressed under the control of an oxygen level-dependent promoter that is activated under low-oxygen or anaerobic environments, e.g., a FNR-responsive promoter.

FNR-responsive promoter sequences are known in the art, and any suitable FNR-responsive promoter sequence(s) may be used in the genetically engineered bacteria of the invention. Any suitable FNR-responsive promoter(s) may be combined with any suitable gene(s) of interest. Non-limiting FNR-responsive promoter sequences are provided in Table 21. In some embodiments, the genetically engineered bacteria of the invention comprise one or more of: SEQ ID NO: 177, SEQ ID NO: 178, nirB1 promoter (SEQ ID NO: 179), nirB2 promoter (SEQ ID NO: 180), nirB3 promoter SEQ ID NO: 181, ydZ promoter (SEQ ID NO: 182), nirB promoter fused to a strong ribosome binding site (SEQ ID NO: 183), ydfZ promoter fused to a strong ribosome binding site (SEQ ID NO: 184), fnrS, an anaerobically induced small RNA gene (fnrS1 promoter SEQ ID NO: 185 or fnrS2 promoter SEQ ID NO: 186), nirB promoter fused to a crp binding site (SEQ ID NO: 187), and fnrS fused to a crp binding site (SEQ ID NO: 188).

In other embodiments, the gene or gene cassette for producing the metabolic and/or satiety molecule is expressed under the control of an oxygen level-dependent promoter fused to a binding site for a transcriptional activator, e.g., CRP. CRP (cyclic AMP receptor protein or catabolite activator protein or CAP) plays a major regulatory role in bacteria by repressing genes responsible for the uptake, metabolism and assimilation of less favorable carbon sources when rapidly metabolizable carbohydrates, such as glucose, are present (Wu et al., 2015). This preference for glucose has been termed glucose repression, as well as carbon catabolite repression (Deutscher, 2008; Gorke and Stilke, 2008). In some embodiments, expression of the gene or gene cassette is controlled by an oxygen level-dependent promoter fused to a CRP binding site. In some embodiments, expression of the gene or gene cassette is controlled by a FNR promoter fused to a CRP binding site. In these embodiments, cyclic AMP binds to CRP when no glucose is present in the environment. This binding causes a conformational change in CRP, and allows CRP to bind tightly to its binding site. CRP binding then activates transcription of the gene or gene cassette by recruiting RNA polymerase to the FNR promoter via direct protein-protein interactions. In the presence of glucose, cyclic AMP does not bind to CRP and gene transcription is repressed. In some embodiments, an oxygen level-dependent promoter (e.g., a FNR-responsive promoter) fused to a binding site for a transcriptional activator is used to ensure that the gene or gene cassette is not expressed under anaerobic conditions when sufficient amounts of glucose are present, e.g., by adding glucose to growth media in vitro.

In some embodiments, the genetically engineered bacteria comprise a stably maintained plasmid or chromosome carrying the gene or gene cassette for producing the metabolic and/or satiety effector molecule, such that the gene or gene cassette can be expressed in the host cell, and the host cell is capable of survival and/or growth in vitro, e.g., in medium, and/or in vivo, e.g., in the gut. In some embodiments, a bacterium may comprise multiple copies of the gene or gene cassette for producing the metabolic and/or satiety effector molecule. In some embodiments, gene or gene cassette for producing the payload is expressed on a low-copy plasmid. In some embodiments, the low-copy plasmid may be useful for increasing stability of expression. In some embodiments, the low-copy plasmid may be useful for decreasing leaky expression under non-inducing conditions. In some embodiments, gene or gene cassette for producing the metabolic and/or satiety effector molecule is expressed on a high-copy plasmid. In some embodiments, the high-copy plasmid may be useful for increasing gene or gene cassette expression. In some embodiments, gene or gene cassette for producing the metabolic and/or satiety effector molecule is expressed on a chromosome.

In some embodiments, the bacteria are genetically engineered to include multiple mechanisms of action (MOAs), e.g., circuits producing multiple copies of the same product (e.g., to enhance copy number) or circuits performing multiple different functions. Examples of insertion sites include, but are not limited to, malE/K, insB/I, araC/BAD, lacZ, dapA, cea, and other shown in FIG. 47. For example, the genetically engineered bacteria may include four copies of GLP-1 inserted at four different insertion sites, e.g., malE/K, insB/I, araC/BAD, and lacZ. Alternatively, the genetically engineered bacteria may include three copies of GLP-1 inserted at three different insertion sites, e.g., malE/K, insB/I, and lacZ, and three copies of a propionate gene cassette inserted at three different insertion sites, e.g., dapA, cea, and araC/BAD.

In some embodiments, the genetically engineered bacteria of the invention produce at least one metabolic and/or satiety effector molecule under inducing conditions and are capable of reducing one or more symptoms of metabolic disease in a subject by at least about 5%, 10%, 20%, 30%, 40%, 50%, 60%, 70%, 80%, 90%, 95%, or more as compared to unmodified bacteria of the same subtype under the same conditions. Symptoms and manifestations of metabolic diseases may be measured by methods known in the art, e.g., glucose tolerance testing, insulin tolerance testing.

In some embodiments, the genetically engineered bacteria produce at least about 1.5-fold, at least about 2-fold, at least about 10-fold, at least about 15-fold, at least about 20-fold, at least about 30-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1,000-fold, or at least about 1,500-fold more of a metabolic and/or satiety effector molecule under inducing conditions than unmodified bacteria of the same subtype under the same conditions. Certain unmodified bacteria will not have detectable levels of the metabolic and/or satiety effector molecule. In embodiments using genetically modified forms of these bacteria, the metabolic and/or satiety effector molecule will be detectable under inducing conditions.

In certain embodiments, the metabolic and/or satiety effector molecule is butyrate. Methods of measuring butyrate levels, e.g., by mass spectrometry, gas chromatography, high-performance liquid chromatography (HPLC), are known in the art (see, e.g., Aboulnaga et al., 2013). In some embodiments, butyrate is measured as butyrate level/bacteria optical density (OD). In some embodiments, measuring the activity and/or expression of one or more gene products in the butyrogenic gene cassette serves as a proxy measurement for butyrate production. In some embodiments, the bacterial cells of the invention are harvested and lysed to measure butyrate production. In alternate embodiments, butyrate production is measured in the bacterial cell medium. In some embodiments, the genetically engineered bacteria produce at least about 1 nM/OD, at least about 10 nM/OD, at least about 100 nM/OD, at least about 500 nM/OD, at least about 1 µM/OD, at least about 10 µM/OD, at least about 100 µM/OD, at least about 500 µM/OD, at least about 1 mM/OD, at least about 2 mM/OD, at least about 3 mM/OD, at least about 5 mM/OD, at least about 10 mM/OD, at least about 20 mM/OD, at least about 30 mM/OD, or at least about 50 mM/OD of butyrate in low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose.

In certain embodiments, the metabolic and/or satiety effector molecule is propionate. Methods of measuring propionate levels, e.g., by mass spectrometry, gas chromatography, high-performance liquid chromatography (HPLC), are known in the art (see, e.g., Hillman 1978; Lukovac et al., 2014). In some embodiments, measuring the activity and/or expression of one or more gene products in the propionate gene cassette serves as a proxy measurement for propionate production. In some embodiments, the bacterial cells of the invention are harvested and lysed to measure propionate production. In alternate embodiments, propionate production is measured in the bacterial cell medium. In some embodiments, the genetically engineered bacteria produce at least about 1 µM, at least about 10 µM, at least about 100 µM, at least about 500 µM, at least about 1 mM, at least about 2 mM, at least about 3 mM, at least about 5 mM, at least about 10 mM, at least about 15 mM, at least about 20 mM, at least about 30 mM, at least about 40 mM, or at least about 50 mM of propionate in low-oxygen conditions, in the presence of certain molecules or metabolites, in the presence of molecules or metabolites associated with liver damage, inflammation or an inflammatory response, or in the presence of some other metabolite that may or may not be present in the gut, such as arabinose.

Table 25 lists a propionate promoter sequence. In some embodiments, the propionate promoter is induced in the mammalian gut.

TABLE 25

Propionate promoter sequence

| Description | Sequence |
|---|---|
| Prp (Propionate) promoter Bold: prpR Lower case: ribosome binding site ATG underlined: start of gene of interest SEQ ID NO: 193 | TTACCCGTCTGGATTTTCAGTACGCGCTTTTAAACGACGCCA CAGCGTGGTACGGCTGATCCCCAAATAACGTGCGGCGGCGCG CTTATCGCCATTAAAGCGTGCGAGCACCTCCTGCAATGGAAG CGCTTCTGCTGACGAGGGCGTGATTTCTGCTGTGGTCCCCAC CAGTTCAGGTAATAATTGCCGCATAAATTGTCTGTCCAGTGT TGGTGCGGGATCGACGCTTAAAAAAAGCGCCAGGCGTTCCAT CATATTCCGCAGTTCGCGAATATTACCGGGCCAATGATAGTT CAGTAGAAGCGGCTGACACTGCGTCAGCCCATGACGCACCGA TTCGGTAAAAGGGATCTCCATCGCGGCCAGCGATTGTTTTAA AAAGTTTTCCGCCAGAGGCAGAATATCAGGCTGTCGCTCGCG CAAGGGGGAAGCGGCAGACGCAGAATGCTCAAACGGTAAAA CAGATCGGTACGAAAACGTCCTTGCGTTATCTCCCGATCCAG ATCGCAATGCGTGGCGCTGATCACCCGGACATCTACCGGGAT CGGCTGATGCCCGCCAACGCGGGTGACGGCTTTTTCCTCCAG TACGCGTAGAAGGCGGGTTTGTAACGGCAGCGGCATTTCGCC AATTTCGTCAAGAAACAGCGTGCCGCCGTGGGCGACCTCAAA CAGCCCCGCACGTCCACCTCGTCTTGAGCCGGTAAACGCTCC CTCCTCATAGCCAAACAGTTCAGCCTCCAGCAACGACTCGGT AATCGCGCCGCAATTAACGGCGACAAAGGGCGGAGAAGGCTT GTTCTGACGGTGGGGCTGACGGTTAAACAACGCCTGATGAAT CGCTTGCGCCGCCAGCTCTTTCCCGGTCCCTGTTTCCCCCTG AATCAGCACTGCCGCGCGGGAACGGGCATAGAGTGTAATCGT ATGGCGAACCTGCTCCATTTGTGGTGAATCGCCGAGGATATC GCTCAGCGCATAACGGGTCTGTAATCCCTTGCTGGAGGTATG CTGGCTATACTGACGCCGTGTCAGGCGGGTCATATCCAGCGC ATCATGGAAAGCCTGACGTACGGTGGCCGCTGAATAAATAAA GATGGCGGTCATTCCTGCCTCTTCCGCCAGGTCGGTAATTAG TCCTGCCCCAATTACAGCCTCAATGCCGTTAGCTTTGAGCTC GTTAATTTGCCCGCGAGCATCCTCTTCAGTGATATAGCTTCG |

TABLE 25-continued

Propionate promoter sequence

| Description | Sequence |
|---|---|
| | CTGTTCAAGACGGAGGTGAAACGTTTTCTGAAAGGCGACCAG |
| | AGCCGGAATGGTCTCCTGATAGGTCACGATTCCCATTGAGGA |
| | AGTCAGCTTTCCCGCTTTTGCCAGAGCCTGTAATACATCGAA |
| | TCCGCTGGGTTTGATGAGGATGACAGGTACCGACAGTCGGCT |
| | TTTTAAATAAGCGCCGTTGGAACCTGCCGCGATAATCGCGTC |
| | GCAGCGTTCGGTTGCCAGTTTTTTGCGAATGTAGGCTACTGC |
| | CTTTTCAAAACCGAGCTGAATAGGCGTGATCGTCGCCAGATG |
| | ATCAAACTCCAGGCTGATATCCCGAAATAGTTCGAACAGGCG |
| | CGTTACCGAGACCGTCCAGATCACCGGTTTATCGCTATTATC |
| | GCGCGAAGCGCTATGCACAGTAACCATCGTCGTAGATTCATG |
| | TTTAAGGAACGAATTCTTGTTTTATAGATGTTTCGTTAATGT |
| | TGCAATGAAACACAGGCCTCCGTTTCATGAAACGTTAGCTGA |
| | CTCGTTTTTCTTGTGACTCGTCTGTCAGTATTAAAAAAGATT |
| | TTTCATTTAACTGATTGTTTTTAAATTGAATTTTATTTAATG |
| | GTTTCTCGGTTTTTGGGTCTGGCATATCCCTTGCTTTAATGA |
| | GTGCATCTTAATTAACAATTCAATAACAAGAGGGCTGAATag |
| | taatttcaacaaaataacgagcattcga<u>atg</u> |

Mutagenesis

In some embodiments, an inducible promoter is operably linked to a detectable product, e.g., GFP, and can be used to screen for mutants. In some embodiments, an oxygen level-dependent promoter is operably linked to a detectable product, e.g., GFP, and can be used to screen for mutants. In some embodiments, the oxygen level-dependent promoter is mutagenized, and mutants are selected based upon the level of detectable product, e.g., by flow cytometry, fluorescence-activated cell sorting (FACS) when the detectable product fluoresces. In some embodiments, one or more transcription factor binding sites is mutagenized to increase or decrease binding. In alternate embodiments, the wild-type binding sites are left intact and the remainder of the regulatory region is subjected to mutagenesis. In some embodiments, the mutant promoter is inserted into the genetically engineered bacteria of the invention to increase expression of the metabolic and/or satiety effector molecule in low-oxygen conditions, as compared to unmutated bacteria of the same subtype under the same conditions. In some embodiments, the oxygen level-sensing transcription factor and/or the oxygen level-dependent promoter is a synthetic, non-naturally occurring sequence. In some embodiments, the transcription factor regulating the mutated promoter senses the presence of certain molecules or metabolites, the presence of molecules or metabolites associated with liver damage, inflammation or an inflammatory response, or the presence of some other metabolite that may or may not be present in the gut, such as arabinose.

In some embodiments, the gene encoding a metabolic and/or satiety effector molecule is mutated to increase expression and/or stability of said molecule in low oxygen conditions, as compared to unmutated bacteria of the same subtype under the same conditions. In some embodiments, one or more of the genes in a gene cassette for producing a metabolic and/or satiety effector molecule is mutated to increase expression of said molecule in low oxygen conditions, as compared to unmutated bacteria of the same subtype under the same conditions.

Multiple Mechanisms of Action

In some embodiments, the bacteria are genetically engineered to include multiple mechanisms of action (MOAs), e.g., circuits producing multiple copies of the same product (e.g., to enhance copy number) or circuits performing multiple different functions. Examples of insertion sites include, but are not limited to, malE/K, insB/I, araC/BAD, lacZ, dapA, cea, and other shown in FIG. 47. For example, the genetically engineered bacteria may include four copies of GLP-1 inserted at four different insertion sites, e.g., malE/K, insB/I, araC/BAD, and lacZ. Alternatively, the genetically engineered bacteria may include three copies of GLP-1 inserted at three different insertion sites, e.g., malE/K, insB/I, and lacZ, and three copies of a butyrogenic gene cassette inserted at three different insertion sites, e.g., dapA, cea, and araC/BAD.

In some embodiments, the bacteria are genetically engineered to include multiple mechanisms of action (MOAs), e.g., circuits producing multiple copies of the same product (e.g., to enhance copy number) or circuits performing multiple different functions. For example, the genetically engineered bacteria may include four copies of the gene, gene(s), or gene cassettes for producing the payload(s) inserted at four different insertion sites. Alternatively, the genetically engineered bacteria may include three copies of the gene, gene(s), or gene cassettes for producing the payload(s) inserted at three different insertion sites and three copies of the gene, gene(s), or gene cassettes for producing the payload(s) inserted at three different insertion sites.

In some embodiments, the genetically engineered bacteria comprise one or more of (1) one or more gene(s) or gene cassette(s) for the production of propionate, as described herein (2) one or more gene(s) or gene cassette(s) for the production of butyrate, as described herein (3) one or more gene(s) or gene cassette(s) for the production of acetate, as described herein (4) one or more gene(s) or gene cassette(s) for the production of one or more of GLP-1 and GLP-1 analogs, as described herein (4) one or more gene(s) or gene cassette(s) for the production of one or more bile salt hydrolases, as described herein (5) one or more gene(s) or gene cassette(s) for the production of one or more transporters, e.g. for the import of bile salts and/or metabolites, e.g. tryptophan and/or tryptophan metabolites, as described herein (6) one or more polypetides for secretion, including but not limited to. GLP-1 and its analogs, bile salt hydrolases, and tryptophan synthesis and/or catabolic enzymes of the tryptophan degradation pathways, in wild type or in mutated form (for increased stability or metabolic activity) (3) one or more components of secretion machinery, as described herein (4) one or more auxotrophies, e.g., delta ThyA (5) one more antibiotic resistances, including but not limited to, kanamycin or chloramphenicol resistance (6) one or more mutations/deletions to increase the flux through a metabolic pathway encoded by one or more genes or gene cassette(s), e.g mutations/deletions in genes in NADH consuming pathways, genes involved in feedback inhibition of a metabolic pathway encoded by the gene(s) or gene cassette(s) genes, as described herein (7) one or more mutations/deletions in one or more genes of the endogenous metabolic pathways, e.g., tryptophan synthesis pathway.

In some embodiments, under conditions where the gene, gene(s), or gene cassettes for producing the payload(s) is expressed, the genetically engineered bacteria of the disclosure produce at least about 1.5-fold, at least about 2-fold, at least about 10-fold, at least about 15-fold, at least about 20-fold, at least about 30-fold, at least about 50-fold, at least about 100-fold, at least about 200-fold, at least about 300-fold, at least about 400-fold, at least about 500-fold, at least about 600-fold, at least about 700-fold, at least about 800-fold, at least about 900-fold, at least about 1,000-fold, or at least about 1,500-fold more of the payload(s) as compared to unmodified bacteria of the same subtype under the same conditions.

In some embodiments, quantitative PCR (qPCR) is used to amplify, detect, and/or quantify mRNA expression levels of the gene, gene(s), or gene cassettes for producing the payload(s). Primers may be designed and used to detect mRNA in a sample according to methods known in the art. In some embodiments, a fluorophore is added to a sample reaction mixture that may contain payload RNA, and a thermal cycler is used to illuminate the sample reaction mixture with a specific wavelength of light and detect the subsequent emission by the fluorophore. The reaction mixture is heated and cooled to predetermined temperatures for predetermined time periods. In certain embodiments, the heating and cooling is repeated for a predetermined number of cycles. In some embodiments, the reaction mixture is heated and cooled to 90-100° C., 60-70° C., and 30-50° C. for a predetermined number of cycles. In a certain embodiment, the reaction mixture is heated and cooled to 93-97° C., 55-65° C., and 35-45° C. for a predetermined number of cycles. In some embodiments, the accumulating amplicon is quantified after each cycle of the qPCR. The number of cycles at which fluorescence exceeds the threshold is the threshold cycle (CT). At least one CT result for each sample is generated, and the CT result(s) may be used to determine mRNA expression levels of the payload(s).

In some embodiments, quantitative PCR (qPCR) is used to amplify, detect, and/or quantify mRNA expression levels of the payload(s). Primers may be designed and used to detect mRNA in a sample according to methods known in the art. In some embodiments, a fluorophore is added to a sample reaction mixture that may contain payload mRNA, and a thermal cycler is used to illuminate the sample reaction mixture with a specific wavelength of light and detect the subsequent emission by the fluorophore. The reaction mixture is heated and cooled to predetermined temperatures for predetermined time periods. In certain embodiments, the heating and cooling is repeated for a predetermined number of cycles. In some embodiments, the reaction mixture is heated and cooled to 90-100° C., 60-70° C., and 30-50° C. for a predetermined number of cycles. In a certain embodiment, the reaction mixture is heated and cooled to 93-97° C., 55-65° C., and 35-45° C. for a predetermined number of cycles. In some embodiments, the accumulating amplicon is quantified after each cycle of the qPCR. The number of cycles at which fluorescence exceeds the threshold is the threshold cycle (CT). At least one CT result for each sample is generated, and the CT result(s) may be used to determine mRNA expression levels of the payload(s).

Secretion

In some embodiments, the genetically engineered bacteria further comprise a native secretion mechanism (e.g., gram positive bacteria) or non-native secretion mechanism (e.g., gram negative bacteria) that is capable of secreting a molecule from the bacterial cytoplasm. Many bacteria have evolved sophisticated secretion systems to transport substrates across the bacterial cell envelope. Substrates, such as small molecules, proteins, and DNA, may be released into the extracellular space or periplasm (such as the gut lumen or other space), injected into a target cell, or associated with the bacterial membrane.

In Gram-negative bacteria, secretion machineries may span one or both of the inner and outer membranes. In some embodiments, the genetically engineered bacteria further comprise a non-native double membrane-spanning secretion system. Double membrane-spanning secretion systems include, but are not limited to, the type I secretion system (T1SS), the type II secretion system (T2SS), the type III secretion system (T3SS), the type IV secretion system (T4SS), the type VI secretion system (T6SS), and the resistance-nodulation-division (RND) family of multi-drug efflux pumps (Pugsley 1993; Gerlach et al., 2007; Collinson et al., 2015; Costa et al., 2015; Reeves et al., 2015; WO2014138324A1, incorporated herein by reference). Examples of such secretion systems are shown in FIGS. 3-6. Mycobacteria, which have a Gram-negative-like cell envelope, may also encode a type VII secretion system (T7SS) (Stanley et al., 2003). With the exception of the T2SS, double membrane-spanning secretions generally transport substrates from the bacterial cytoplasm directly into the extracellular space or into the target cell. In contrast, the T2SS and secretion systems that span only the outer membrane may use a two-step mechanism, wherein substrates are first translocated to the periplasm by inner membrane-spanning transporters, and then transferred to the outer membrane or secreted into the extracellular space. Outer membrane-spanning secretion systems include, but are not limited to, the type V secretion or autotransporter system (T5SS), the curli secretion system, and the chaperone-usher pathway for pili assembly (Saier, 2006; Costa et al., 2015).

In some embodiments, the genetically engineered bacteria of the invention further comprise a type III or a type III-like secretion system (T3SS) from *Shigella, Salmonella, E. coli, Bivrio, Burkholderia, Yersinia, Chlamydia,* or *Pseudomonas*. The T3SS is capable of transporting a protein from the bacterial cytoplasm to the host cytoplasm through a needle complex. The T3SS may be modified to secrete the molecule from the bacterial cytoplasm, but not inject the molecule into the host cytoplasm. Thus, the molecule is secreted into the gut lumen or other extracellular space. In some embodiments, the genetically engineered bacteria comprise said modified T3SS and are capable of secreting the molecule of interest from the bacterial cytoplasm. In some embodiments, the secreted molecule, such as a heterologouse protein or peptide comprises a type III secretion sequence that allows the molecule of interest o be secreted from the bacteria.

In some embodiments, a flagellar type III secretion pathway is used to secrete the molecule of interest. In some embodiments, an incomplete flagellum is used to secrete a therapeutic peptide of interest by recombinantly fusing the peptide to an N-terminal flagellar secretion signal of a native flagellar component. In this manner, the intracellularly expressed chimeric peptide can be mobilized across the inner and outer membranes into the surrounding host environment.

In some embodiments, a Type V Autotransporter Secretion System is used to secrete the molecule of interest, e.g., therapeutic peptide. Due to the simplicity of the machinery and capacity to handle relatively large protein fluxes, the Type V secretion system is attractive for the extracellular production of recombinant proteins. As shown in FIG. 10, a therapeutic peptide (star) can be fused to an N-terminal secretion signal, a linker, and the beta-domain of an autotransporter. The N-terminal signal sequence directs the protein to the SecA-YEG machinery which moves the protein across the inner membrane into the periplasm, followed by subsequent cleavage of the signal sequence. The Beta-domain is recruited to the Bam complex ('Beta-barrel assembly machinery') where the beta-domain is folded and inserted into the outer membrane as a beta-barrel structure. The therapeutic peptide is thread through the hollow pore of the beta-barrel structure ahead of the linker sequence. Once exposed to the extracellular environment, the therapeutic peptide can be freed from the linker system by an autocatalytic cleavage (left side of Bam complex) or by targeting of a membrane-associated peptidase (black scissors; right side of Bam complex) to a complimentary protease cut site in the linker. Thus, in some embodiments, the secreted molecule, such as a heterologouse protein or peptide comprises an N-terminal secretion signal, a linker, and beta-domain of an autotransporter so as to allow the molecule to be secreted from the bacteria.

Figure 11:
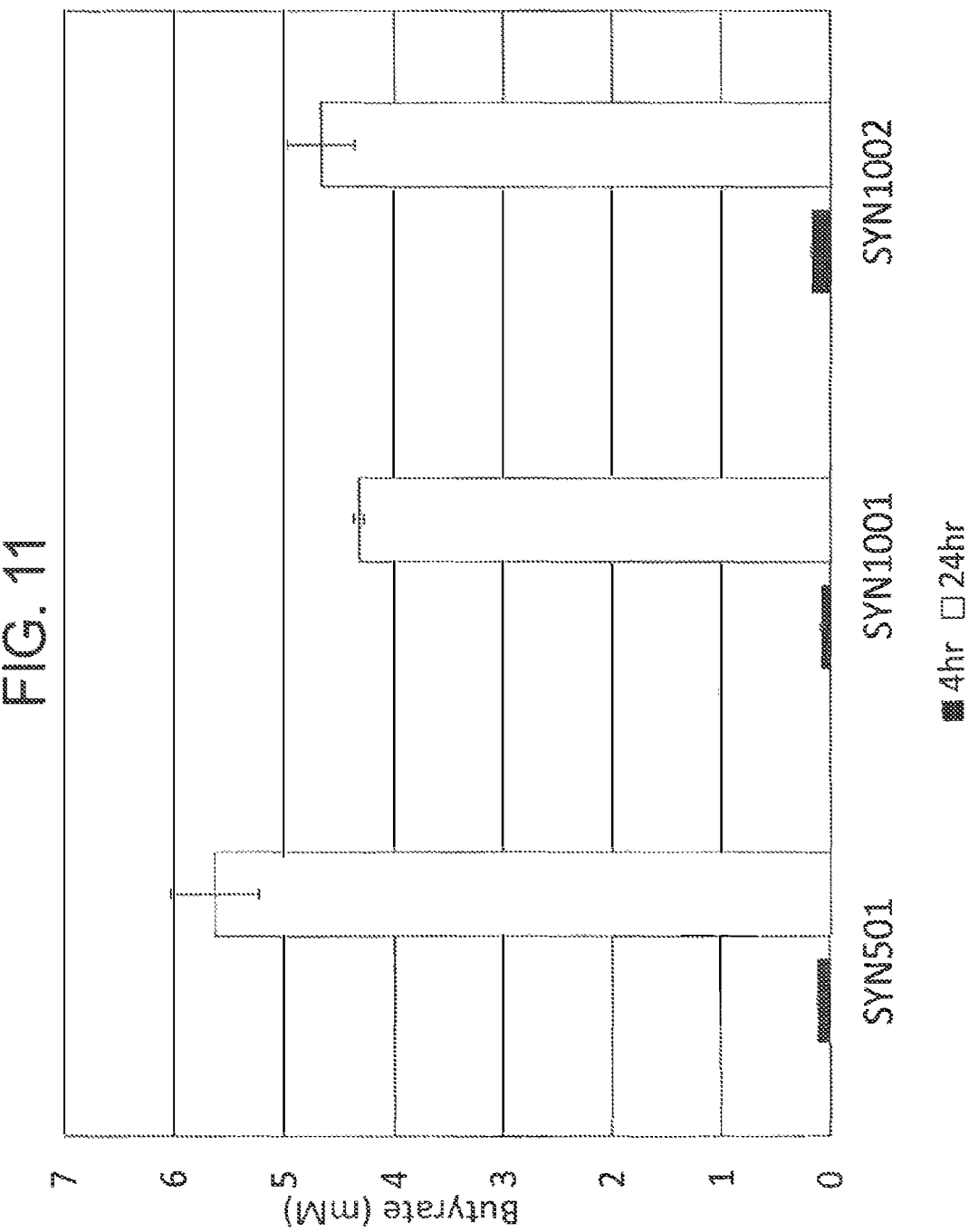
FIG. 11 depicts a bar graph showing butyrate concentrations produced in vitro by strains comprising chromsolmally integrated butyrate copies as compared to plasmid cpopies. Integrated butyrate strains, SYN1001 and SYN1002 gave comparable butyrate production to the plasmid strain SYN501.

In some embodiments, a Hemolysin-based Secretion System is used to secrete the molecule of interest, e.g., therapeutic peptide. Type I Secretion systems offer the advantage of translocating their passenger peptide directly from the cytoplasm to the extracellular space, obviating the two-step process of other secretion types. FIG. 11 shows the alpha-hemolysin (HlyA) of uropathogenic *Escherichia coli*. This pathway uses HlyB, an ATP-binding cassette transporter; HlyD, a membrane fusion protein; and TolC, an outer membrane protein. The assembly of these three proteins forms a channel through both the inner and outer membranes. Natively, this channel is used to secrete HlyA, however, to secrete the therapeutic peptide of the present disclosure, the secretion signal-containing C-terminal portion of HlyA is fused to the C-terminal portion of a therapeutic peptide (star) to mediate secretion of this peptide.

In alternate embodiments, the genetically engineered bacteria further comprise a non-native single membrane-spanning secretion system. Single membrane-spanning transporters may act as a component of a secretion system, or may export substrates independently. Such transporters include, but are not limited to, ATP-binding cassette translocases, flagellum/virulence-related translocases, conjugation-related translocases, the general secretory system (e.g., the SecYEG complex in *E. coli*), the accessory secretory system in mycobacteria and several types of Gram-positive bacteria (e.g., *Bacillus anthracis, Lactobacillus johnsonii, Corynebacterium glutamicum, Streptococcus gordonii, Staphylococcus aureus*), and the twin-arginine translocation (TAT) system (Saier, 2006; Rigel and Braunstein, 2008; Albiniak et al., 2013). It is known that the general secretory and TAT systems can both export substrates with cleavable N-terminal signal peptides into the periplasm, and have been explored in the context of biopharmaceutical production. The TAT system may offer particular advantages, however, in that it is able to transport folded substrates, thus eliminating the potential for premature or incorrect folding. In certain embodiments, the genetically engineered bacteria comprise a TAT or a TAT-like system and are capable of secreting the molecule of interest from the bacterial cytoplasm. One of ordinary skill in the art would appreciate that the secretion systems disclosed herein may be modified to act in different species, strains, and subtypes of bacteria, and/or adapted to deliver different payloads.

In order to translocate a protein, e.g., therapeutic polypeptide, to the extracellular space, the polypeptide must first be translated intracellularly, mobilized across the inner membrane and finally mobilized across the outer membrane. Many effector proteins (e.g., therapeutic polypeptides)—particularly those of eukaryotic origin—contain disulphide bonds to stabilize the tertiary and quaternary structures. While these bonds are capable of correctly forming in the oxidizing periplasmic compartment with the help of periplasmic chaperones, in order to translocate the polypeptide across the outer membrane the disulphide bonds must be reduced and the protein unfolded again.

One way to secrete properly folded proteins in gram-negative bacteria-particularly those requiring disulphide bonds—is to target the periplasm in a bacteria with a destabilized outer membrane. In this manner the protein is mobilized into the oxidizing environment and allowed to fold properly. In contrast to orchestrated extracellular secretion systems, the protein is then able to escape the periplasmic space in a correctly folded form by membrane leakage. These "leaky" gram-negative mutants are therefore capable of secreting bioactive, properly disulphide-bonded polypeptides. In some embodiments, the genetically engineered bacteria have a "leaky" or destabilized outer membrane. Destabilizing the bacterial outer membrane to induce leakiness can be accomplished by deleting or mutagenizing genes responsible for tethering the outer membrane to the rigid peptidoglycan skeleton, including for example, lpp, ompC, ompA, ompF, tolA, tolB, pal, degS, degP, and nlpI. Lpp is the most abundant polypeptide in the bacterial cell existing at ~500,000 copies per cell and functions as the primary 'staple' of the bacterial cell wall to the peptidoglycan. 1. Silhavy, T. J., Kahne, D. & Walker, S. The bacterial cell envelope. *Cold Spring Harb Perspect Biol* 2, a000414 (2010). TolA-PAL and OmpA complexes function similarly to Lpp and are other deletion targets to generate a leaky phenotype. Additionally, leaky phenotypes have been observed when periplasmic proteases are deactived. The periplasm is very densely packed with protein and therefore encode several periplasmic proteins to facilitate protein turnover. Removal of periplasmic proteases such as degS, degP or nlpI can induce leaky phenotypes by promoting an excessive build-up of periplasmic protein. Mutation of the proteases can also preserve the effector polypeptide by preventing targeted degradation by these proteases. Moreover, a combination of these mutations may synergistically enhance the leaky phenotype of the cell without major sacrifices in cell viability. Thus, in some embodiments, the engineered bacteria have one or more deleted or mutated membrane genes. In some embodiments, the engineered bacteria have a deleted or mutated lpp gene. In some embodiments, the engineered bacteria have one or more deleted or mutated gene(s), selected from ompA, ompA, and ompF genes. In some embodiments, the engineered bacteria have one or more deleted or mutated gene(s), selected from tolA, tolB, and pal genes. in some embodiments, the engineered bacteria have one or more deleted or mutated periplasmic protease genes. In some embodiments, the engineered bacteria have one or more deleted or mutated periplasmic protease genes selected from degS, degP, and nlpI. In some embodiments, the engineered bacteria have one or more deleted or mutated gene(s), selected from lpp, ompA, ompA, ompF, tolA, tolB, pal, degS, degP, and nlpl genes.

To minimize disturbances to cell viability, the leaky phenotype can be made inducible by placing one or more membrane or periplasmic protease genes, e.g., selected from lpp, ompA, ompA, ompF, tolA, tolB, pal, degS, degP, and nlpl, under the control of an inducible promoter For example, expression of lpp or other cell wall stability protein or periplasmic protease can be repressed in conditions where the therapeutic polypeptide needs to be delivered (secreted). For instance, under inducing conditions a transcriptional repressor protein or a designed antisense RNA can be expressed which reduces transcription or translation of a target membrane or periplasmic protease gene. Conversely, overexpression of certain peptides can result in a destabilized phenotype, e.g., over expression of colicins or the third topological domain of TolA, which peptide overexpression can be induced in conditions in which the therapeutic polypeptide needs to be delivered (secreted). These sorts of strategies would decouple the fragile, leaky phenotypes from biomass production. Thus, in some embodiments, the engineered bacteria have one or more membrane and/or periplasmic protease genes under the control of an inducible promoter.

The Tables 26 and 27 below lists secretion systems for Gram positive bacteria and Gram negative bacteria.

TABLE 26

Secretion systems for gram positive bacteria

| Bacterial Strain | Relevant Secretion System |
| --- | --- |
| C. novyi-NT (Gram+) | Sec pathway |
|  | Twin-arginine (TAT) pathway |
| C. butryicum (Gram+) | Sec pathway |
|  | Twin-arginine (TAT) pathway |
| Listeria monocytogenes (Gram+) | Sec pathway |
|  | Twin-arginine (TAT) pathway |

TABLE 27

Secretion Systems for Gram negative bacteria
Protein secretary pathways (SP) in gram-negative bacteria and their descendants

| Type (Abbreviation) | Name | TC#[2] | Bacteria | Archaea | Eukarya | # Proteins/ System | Energy Source |
| --- | --- | --- | --- | --- | --- | --- | --- |
| IMPS - Gram-negative bacterial inner membrane channel-forming translocases | | | | | | | |
| ABC (SIP) | ATP binding cassette translocase | 3.A.1 | + | + | + | 3-4 | ATP |
| SEC (IISP) | General secretory translocase | 3.A.5 | + | + | + | ~12 | GTP OR ATP + PMF |
| Fla/Path (IIISP) | Flagellum/virulence-related translocase | 3.A.6 | + | − | − | >10 | ATP |
| Conj (IVSP) | Conjugation-related translocase | 3.A.7 | + | − | − | >10 | ATP |
| Tat (IISP) | Twin-arginine targeting translocase | 2.A.64 | + | + | +(chloroplasts) | 2-4 | PMF |
| Oxa1 (YidC) | Cytochrome oxidase biogenesis family | 2.A.9 | + | + | +(mitochondria chloroplasts) | 1 | None or PMF |
| MscL | Large conductance mechanosensitive channel family | 1.A.22 | + | + | + | 1 | None |
| Holins | Holin functional superfamily | 1.E.1•21 | + | − | − | 1 | None |
| Eukaryotic Organelles | | | | | | | |
| MPT | Mitochondrial protein translocase | 3.A.B | − | − | +(mitochondrial) | >20 | ATP |
| CEPT | Chloroplast envelope protein translocase | 3.A.9 | (+) | − | +(chloroplasts) | ≥3 | GTP |
| Bcl-2 | Eukaryotic Bcl-2 family (programmed cell death) | 1.A.21 | − | − | + | 1? | None |

TABLE 27-continued

Secretion Systems for Gram negative bacteria
Protein secretary pathways (SP) in gram-negative bacteria and their descendants

| Type (Abbreviation) | Name | TC#[2] | Bacteria | Archaea | Eukarya | # Proteins/ System | Energy Source |
|---|---|---|---|---|---|---|---|
| Gram-negative bacterial outer membrane channel-forming translocases | | | | | | | |
| MTB (IISP) | Main terminal branch of the general secretory translocase | 3.A.15 | +[b] | – | – | ~14 | ATP; PMF |
| FUP | Fimbrial | 1.B.11 | +[b] | – | – | 1 | None |
| AT-1 | usher protein Autotransporter-1 | 1.B.12 | +[b] | – | | 1 | None |
| AT-2 | Autotransporter-2 | 1.B.40 | +[b] | – | – | 1 | None |
| OMF (ISP) | | 1.B.17 | +[b] | | +(?) | 1 | None |
| TPS | | 1.B.20 | + | – | + | 1 | None |
| Secretin (IISP and IISP) | | 1.B.22 | +[b] | | – | 1 | None |
| OmpIP | Outer membrane insertion porin | 1.B.33 | + | – | +(mitochondria; chloroplasts) | ≥4 | None? |

The above tables for gram positive and gram negative bacteria list secretion systems that can be used to secrete polypeptides and other molecules from the engineered bacteria, which are reviewed in Milton H. Saier, Jr. Microbe/Volume 1, Number 9, 2006 "Protein Secretion Systems in Gram-Negative Bacteria Gram-negative bacteria possess many protein secretion-membrane insertion systems that apparently evolved independently", the contents of which is herein incorporated by reference in its entirety.

Any of the secretion systems described herein may according to the disclosure be employed to secrete the proteins of interest. Non-limiting examples of proteins of interest include GLP-1 peptides, GLP-1 analogs, proglucagon peptides, catabolic enzymes, including but not limited to IDO, TDO, kynureninase, other tryptophan pathway catabolic enzymes, e.g. in the ndole pathway and/or the kynurenine pathway as described herein, and bile salt hydrolases as described herein. These polypeptides may be mutated to increase stability, resistance to protease digestion, and/or activity.

Essential Genes and Auxotrophs

As used herein, the term "essential gene" refers to a gene which is necessary to for cell growth and/or survival. Bacterial essential genes are well known to one of ordinary skill in the art, and can be identified by directed deletion of genes and/or random mutagenesis and screening (see, e.g., Zhang and Lin, 2009, DEG 5.0, a database of essential genes in both prokaryotes and eukaryotes, Nucl. Acids Res., 37:D455-D458 and Gerdes et al., Essential genes on metabolic maps, Curr. Opin. Biotechnol., 17(5):448-456, the entire contents of each of which are expressly incorporated herein by reference).

An "essential gene" may be dependent on the circumstances and environment in which an organism lives. For example, a mutation of, modification of, or excision of an essential gene may result in the genetically engineered bacteria of the disclosure becoming an auxotroph. An auxotrophic modification is intended to cause bacteria to die in the absence of an exogenously added nutrient essential for survival or growth because they lack the gene(s) necessary to produce that essential nutrient.

An auxotrophic modification is intended to cause bacteria to die in the absence of an exogenously added nutrient essential for survival or growth because they lack the gene(s) necessary to produce that essential nutrient. In some embodiments, any of the genetically engineered bacteria described herein also comprise a deletion or mutation in a gene required for cell survival and/or growth. In one embodiment, the essential gene is a DNA synthesis gene, for example, thyA. In another embodiment, the essential gene is a cell wall synthesis gene, for example, dapA. In yet another embodiment, the essential gene is an amino acid gene, for example, serA or MetA. Any gene required for cell survival and/or growth may be targeted, including but not limited to, cysE, glnA, ilvD, leuB, lysA, serA, metA, glyA, hisB, ilvA, pheA, proA, thrC, trpC, tyrA, thyA, uraA, dapA, dapB, dapD, dapE, dapF, flhD, metB, metC, proAB, and thi1, as long as the corresponding wild-type gene product is not produced in the bacteria.

Table 28 lists depicts exemplary bacterial genes which may be disrupted or deleted to produce an auxotrophic strain. These include, but are not limited to, genes required for oligonucleotide synthesis, amino acid synthesis, and cell wall synthesis.

TABLE 28

Non-limiting Examples of Bacterial Genes
Useful for Generation of an Auxotroph

| Amino Acid | Oligonucleotide | Cell Wall |
|---|---|---|
| cysE | thyA | dapA |
| glnA | uraA | dapB |
| ilvD | | dapD |
| leuB | | dapE |
| lysA | | dapF |

TABLE 28-continued

Non-limiting Examples of Bacterial Genes
Useful for Generation of an Auxotroph

| Amino Acid | Oligonucleotide | Cell Wall |
|---|---|---|
| serA | | |
| metA | | |
| glyA | | |
| hisB | | |
| ilvA | | |
| pheA | | |
| proA | | |
| thrC | | |
| trpC | | |
| tyrA | | |

Table 28 shows the survival of various amino acid auxotrophs in the mouse gut, as detected 24 hrs and 48 hrs post-gavage. These auxotrophs were generated using BW25113, a non-Nissle strain of *E. coli*.

TABLE 28

Survival of amino acid auxotrophs in the mouse gut

| Gene | AA Auxotroph | Pre-Gavage | 24 hours | 48 hours |
|---|---|---|---|---|
| argA | Arginine | Present | Present | Absent |
| cysE | Cysteine | Present | Present | Absent |
| glnA | Glutamine | Present | Present | Absent |
| glyA | Glycine | Present | Present | Absent |
| hisB | Histidine | Present | Present | Present |
| ilvA | Isoleucine | Present | Present | Absent |
| leuB | Leucine | Present | Present | Absent |
| lysA | Lysine | Present | Present | Absent |
| metA | Methionine | Present | Present | Present |
| pheA | Phenylalanine | Present | Present | Present |
| proA | Proline | Present | Present | Absent |
| serA | Serine | Present | Present | Present |
| thrC | Threonine | Present | Present | Present |
| trpC | Tryptophan | Present | Present | Present |
| tyrA | Tyrosine | Present | Present | Present |
| ilvD | Valine/Isoleucine/Leucine | Present | Present | Absent |
| thyA | Thiamine | Present | Absent | Absent |
| uraA | Uracil | Present | Absent | Absent |
| flhD | FlhD | Present | Present | Present |

For example, thymine is a nucleic acid that is required for bacterial cell growth; in its absence, bacteria undergo cell death. The thyA gene encodes thimidylate synthetase, an enzyme that catalyzes the first step in thymine synthesis by converting dUMP to dTMP (Sat et al., 2003). In some embodiments, the bacterial cell of the disclosure is a thyA auxotroph in which the thyA gene is deleted and/or replaced with an unrelated gene. A thyA auxotroph can grow only when sufficient amounts of thymine are present, e.g., by adding thymine to growth media in vitro, or in the presence of high thymine levels found naturally in the human gut in vivo. In some embodiments, the bacterial cell of the disclosure is auxotrophic in a gene that is complemented when the bacterium is present in the mammalian gut. Without sufficient amounts of thymine, the thyA auxotroph dies. In some embodiments, the auxotrophic modification is used to ensure that the bacterial cell does not survive in the absence of the auxotrophic gene product (e.g., outside of the gut).

Diaminopimelic acid (DAP) is an amino acid synthetized within the lysine biosynthetic pathway and is required for bacterial cell wall growth (Meadow et al., 1959; Clarkson et al., 1971). In some embodiments, any of the genetically engineered bacteria described herein is a dapD auxotroph in which dapD is deleted and/or replaced with an unrelated gene. A dapD auxotroph can grow only when sufficient amounts of DAP are present, e.g., by adding DAP to growth media in vitro. Without sufficient amounts of DAP, the dapD auxotroph dies. In some embodiments, the auxotrophic modification is used to ensure that the bacterial cell does not survive in the absence of the auxotrophic gene product (e.g., outside of the gut).

In other embodiments, the genetically engineered bacterium of the present disclosure is a uraA auxotroph in which uraA is deleted and/or replaced with an unrelated gene. The uraA gene codes for UraA, a membrane-bound transporter that facilitates the uptake and subsequent metabolism of the pyrimidine uracil (Andersen et al., 1995). A uraA auxotroph can grow only when sufficient amounts of uracil are present, e.g., by adding uracil to growth media in vitro. Without sufficient amounts of uracil, the uraA auxotroph dies. In some embodiments, auxotrophic modifications are used to ensure that the bacteria do not survive in the absence of the auxotrophic gene product (e.g., outside of the gut).

In complex communities, it is possible for bacteria to share DNA. In very rare circumstances, an auxotrophic bacterial strain may receive DNA from a non-auxotrophic strain, which repairs the genomic deletion and permanently rescues the auxotroph. Therefore, engineering a bacterial strain with more than one auxotroph may greatly decrease the probability that DNA transfer will occur enough times to rescue the auxotrophy. In some embodiments, the genetically engineered bacteria of the invention comprise a deletion or mutation in two or more genes required for cell survival and/or growth.

Other examples of essential genes include, but are not limited to yhbV, yagG, hemB, secD, secF, ribD, ribE, thiL, dxs, ispA, dnaX, adk, hemH, lpxH, cysS, fold, rplT, infC, thrS, nadE, gapA, yeaZ, aspS, argS, pgsA, yefM, metG, folE, yejM, gyrA, nrdA, nrdB, folC, accD, fabB, gltX, ligA, zipA, dapE, dapA, der, hisS, ispG, suhB, tadA, acpS, era, rnc, ftsB, eno, pyrG, chpR, lgt, fbaA, pgk, yqgD, metK, yqgF, plsC, ygiT, pare, ribB, cca, ygjD, tdcF, yraL, yihA, ftsN, murI, murB, birA, secE, nusG, rplJ, rplL, rpoB, rpoC, ubiA, plsB, lexA, dnaB, ssb, alsK, groS, psd, orn, yjeE, rpsR, chpS, ppa, valS, yjgP, yjgQ, dnaC, ribF, lspA, ispH, dapB, folA, imp, yabQ, ftsL, ftsI, murE, murF, mraY, murD, ftsW, murG, murC, ftsQ, ftsA, ftsZ, lpxC, secM, secA, can, folK, hemL, yadR, dapD, map, rpsB, infB, nusA, ftsH, obgE, rpmA, rplU, ispB, murA, yrbB, yrbK, yhbN, rpsI, rplM, degS, mreD, mreC, mreB, accB, accC, yrdC, def, fmt, rplQ, rpoA, rpsD, rpsK, rpsM, entD, mrdB, mrdA, nadD, hlepB, rpoE, pssA, yfiO, rplS, trmD, rpsP, ffh, grpE, yfjB, csrA, ispF, ispD, rplW, rplD, rplC, rpsJ, fusA, rpsG, rpsL, trpS, yrfF, asd, rpoH, ftsX, ftsE, ftsY, frr, dxr, ispU, rfaK, kdtA, coaD, rpmB, dfp, dut, gmk, spot, gyrB, dnaN, dnaA, rpmH, rnpA, yidC, tnaB, glmS, glmU, wzyE, hemD, hemC, yigP, ubiB, ubiD, hemG, secY, rplO, rpmD, rpsE, rplR, rplF, rpsH, rpsN, rplE, rplX, rplN, rpsQ, rpmC, rplP, rpsC, rplV, rpsS, rplB, cdsA, yaeL, yaeT, lpxD, fabZ, lpxA, lpxB, dnaE, accA, tilS, proS, yafF, tsf, pyrH, olA, rlpB, leuS, lnt, glnS, fldA, cydA, infA, cydC, ftsK, lolA, serS, rpsA, msbA, lpxK, kdsB, mukF, mukE, mukB, asnS, fabA, mviN, rne, yceQ, fabD, fabG, acpP, tmk, holB, lolC, lolD, lolE, purB, ymfK, minE, mind, pth, rsA, ispE, lolB, hemA, prfA, prmC, kdsA, topA, ribA, fabI, racR, dicA, ydfB, tyrS, ribC, ydiL, pheT, pheS, yhhQ, bcsB, glyQ, yibJ, and gpsA. Other essential genes are known to those of ordinary skill in the art.

In some embodiments, the genetically engineered bacterium of the present disclosure is a synthetic ligand-dependent essential gene (SLiDE) bacterial cell. SLiDE bacterial cells are synthetic auxotrophs with a mutation in one or more essential genes that only grow in the presence of a particular ligand (see Lopez and Anderson "Synthetic Auxotrophs with Ligand-Dependent Essential Genes for a BL21 (DE3 Biosafety Strain," ACS Synthetic Biology (2015) DOI: 10.1021/acssynbio.5b00085, the entire contents of which are expressly incorporated herein by reference).

In some embodiments, the SLiDE bacterial cell comprises a mutation in an essential gene. In some embodiments, the essential gene is selected from the group consisting of pheS, dnaN, tyrS, metG, and adk. In some embodiments, the essential gene is dnaN comprising one or more of the following mutations: H191N, R240C, I317S, F319V, L340T, V347I, and S345C. In some embodiments, the essential gene is dnaN comprising the mutations H191N, R240C, I317S, F319V, L340T, V347I, and S345C. In some embodiments, the essential gene is pheS comprising one or more of the following mutations: F125G, P183T, P184A, R186A, and I188L. In some embodiments, the essential gene is pheS comprising the mutations F125G, P183T, P184A, R186A, and I188L. In some embodiments, the essential gene is tyrS comprising one or more of the following mutations: L36V, C38A and F40G. In some embodiments, the essential gene is tyrS comprising the mutations L36V, C38A and F40G. In some embodiments, the essential gene is metG comprising one or more of the following mutations: E45Q, N47R, I49G, and A51C. In some embodiments, the essential gene is metG comprising the mutations E45Q, N47R, I49G, and A51C. In some embodiments, the essential gene is adk comprising one or more of the following mutations: I4L, L5I and L6G. In some embodiments, the essential gene is adk comprising the mutations I4L, L5I and L6G.

In some embodiments, the genetically engineered bacterium is complemented by a ligand. In some embodiments, the ligand is selected from the group consisting of benzothiazole, indole, 2-aminobenzothiazole, indole-3-butyric acid, indole-3-acetic acid, and L-histidine methyl ester. For example, bacterial cells comprising mutations in metG (E45Q, N47R, I49G, and A51C) are complemented by benzothiazole, indole, 2-aminobenzothiazole, indole-3-butyric acid, indole-3-acetic acid or L-histidine methyl ester. Bacterial cells comprising mutations in dnaN (H191N, R240C, I317S, F319V, L340T, V347I, and S345C) are complemented by benzothiazole, indole or 2-aminobenzothiazole. Bacterial cells comprising mutations in pheS (F125G, P183T, P184A, R186A, and I188L) are complemented by benzothiazole or 2-aminobenzothiazole. Bacterial cells comprising mutations in tyrS (L36V, C38A, and F40G) are complemented by benzothiazole or 2-aminobenzothiazole. Bacterial cells comprising mutations in adk (I4L, L5I and L6G) are complemented by benzothiazole or indole.

In some embodiments, the genetically engineered bacterium comprises more than one mutant essential gene that renders it auxotrophic to a ligand. In some embodiments, the bacterial cell comprises mutations in two essential genes. For example, in some embodiments, the bacterial cell comprises mutations in tyrS (L36V, C38A, and F40G) and metG (E45Q, N47R, I49G, and A51C). In other embodiments, the bacterial cell comprises mutations in three essential genes. For example, in some embodiments, the bacterial cell comprises mutations in tyrS (L36V, C38A, and F40G), metG (E45Q, N47R, I49G, and A51C), and pheS (F125G, P183T, P184A, R186A, and I188L).

Figure 56A:
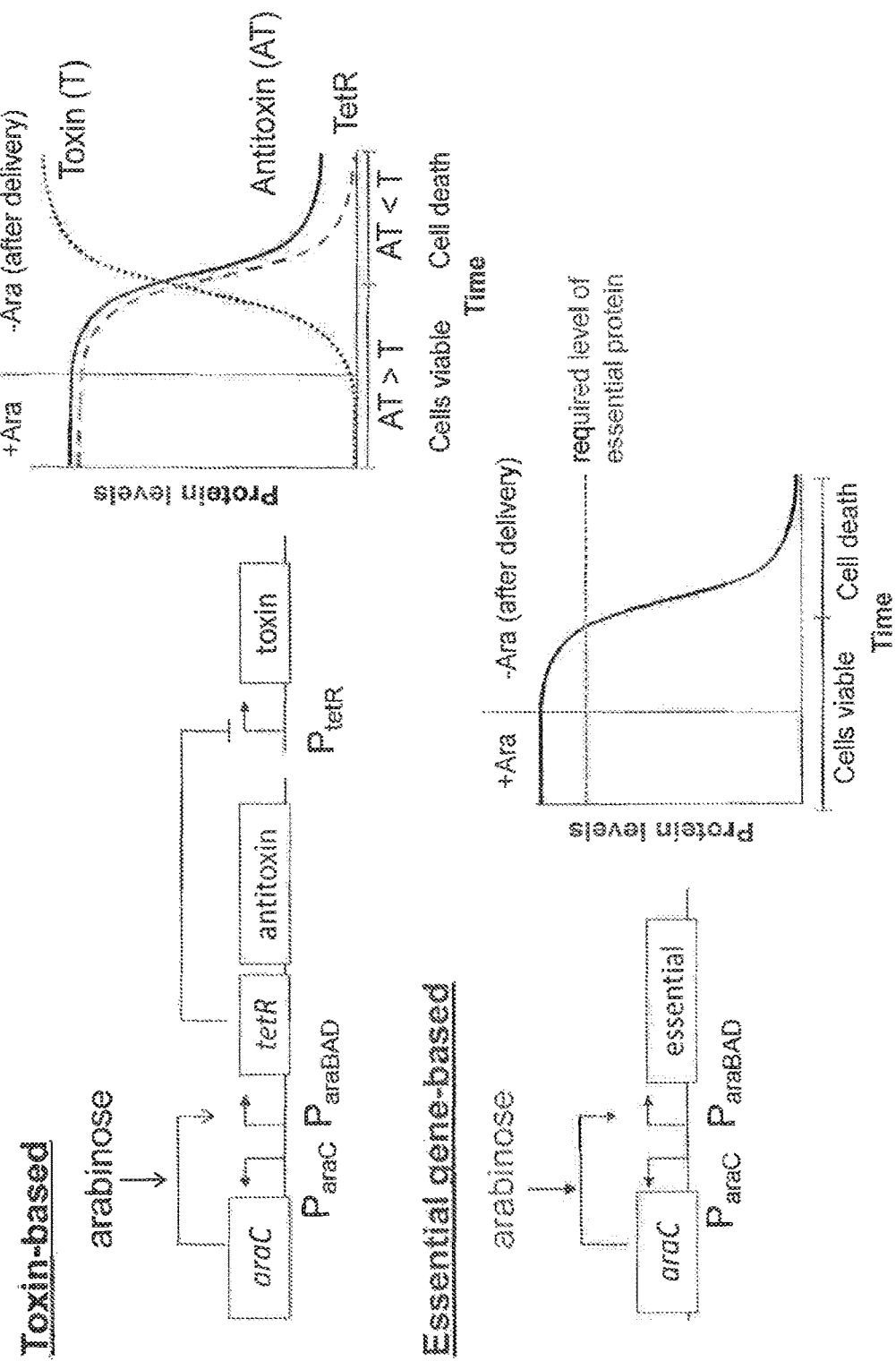
FIG. 56A depicts another non-limiting embodiment of the disclosure, wherein the expression of a heterologous gene is activated by an exogenous environmental signal. In the absence of arabinose, the AraC transcription factor adopts a conformation that represses transcription. In the presence of arabinose, the AraC transcription factor undergoes a conformational change that allows it to bind to and activate the ParaBAD promoter ($P_{araBAD}$), which induces expression of the Tet repressor (TetR) and an anti-toxin. The anti-toxin builds up in the recombinant bacterial cell, while TetR prevents expression of a toxin (which is under the control of a promoter having a TetR binding site). However, when arabinose is not present, both the anti-toxin and TetR are not expressed. Since TetR is not present to repress expression of the toxin, the toxin is expressed and kills the cell.
Figure 56B:
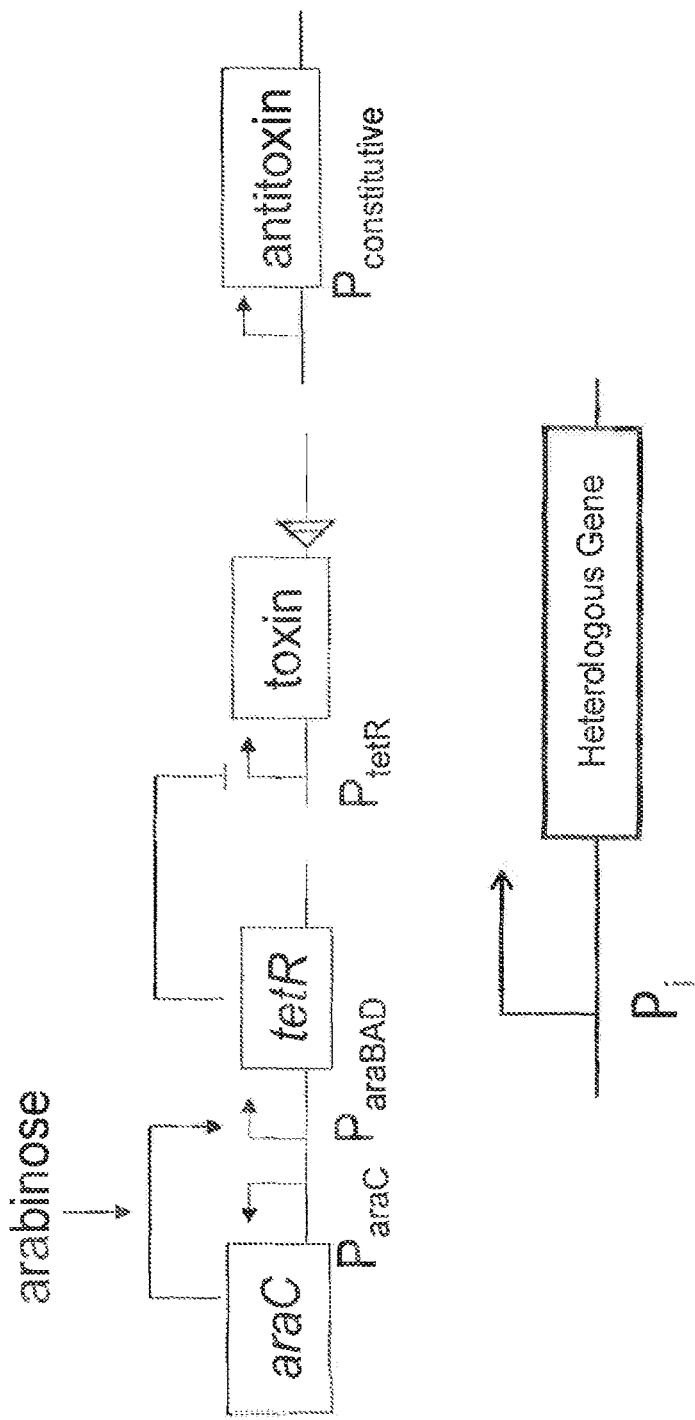
FIG. 56B depicts a non-limiting embodiment of the disclosure, where an anti-toxin is expressed from a constitutive promoter, and expression of a heterologous gene is activated by an exogenous environmental signal. In the absence of arabinose, the AraC transcription factor adopts a conformation that represses transcription. In the presence of arabinose, the AraC transcription factor undergoes a conformational change that allows it to bind to and activate the araBAD promoter, which induces expression of TetR, thus preventing expression of a toxin. However, when arabinose is not present, TetR is not expressed, and the toxin is expressed, eventually overcoming the anti-toxin and killing the cell. The constitutive promoter regulating expression of the anti-toxin should be a weaker promoter than the promoter driving expression of the toxin. The araC gene is under the control of a constitutive promoter in this circuit.
Figure 56C:
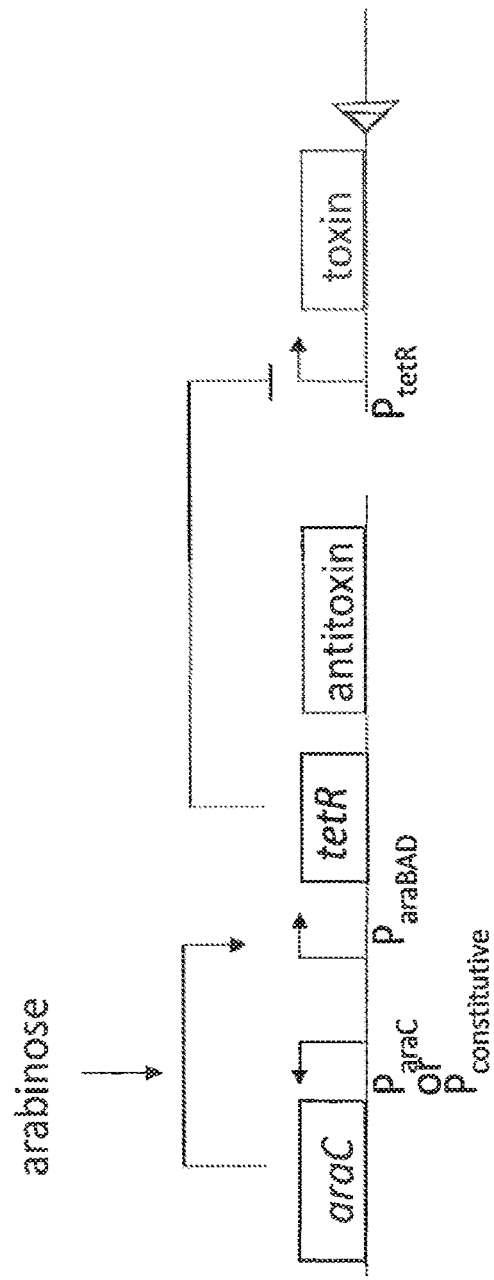
FIG. 56C depicts another non-limiting embodiment of the disclosure, wherein the expression of a heterologous gene is activated by an exogenous environmental signal. In the absence of arabinose, the AraC transcription factor adopts a conformation that represses transcription. In the presence of arabinose, the AraC transcription factor undergoes a conformational change that allows it to bind to and activate the araBAD promoter, which induces expression of the Tet repressor (TetR) and an anti-toxin. The anti-toxin builds up in the recombinant bacterial cell, while TetR prevents expression of a toxin (which is under the control of a promoter having a TetR binding site). However, when arabinose is not present, both the anti-toxin and TetR are not expressed. Since TetR is not present to repress expression of the toxin, the toxin is expressed and kills the cell. The araC gene is either under the control of a constitutive promoter or an inducible promoter (e.g., AraC promoter) in this circuit.
Figure 57:
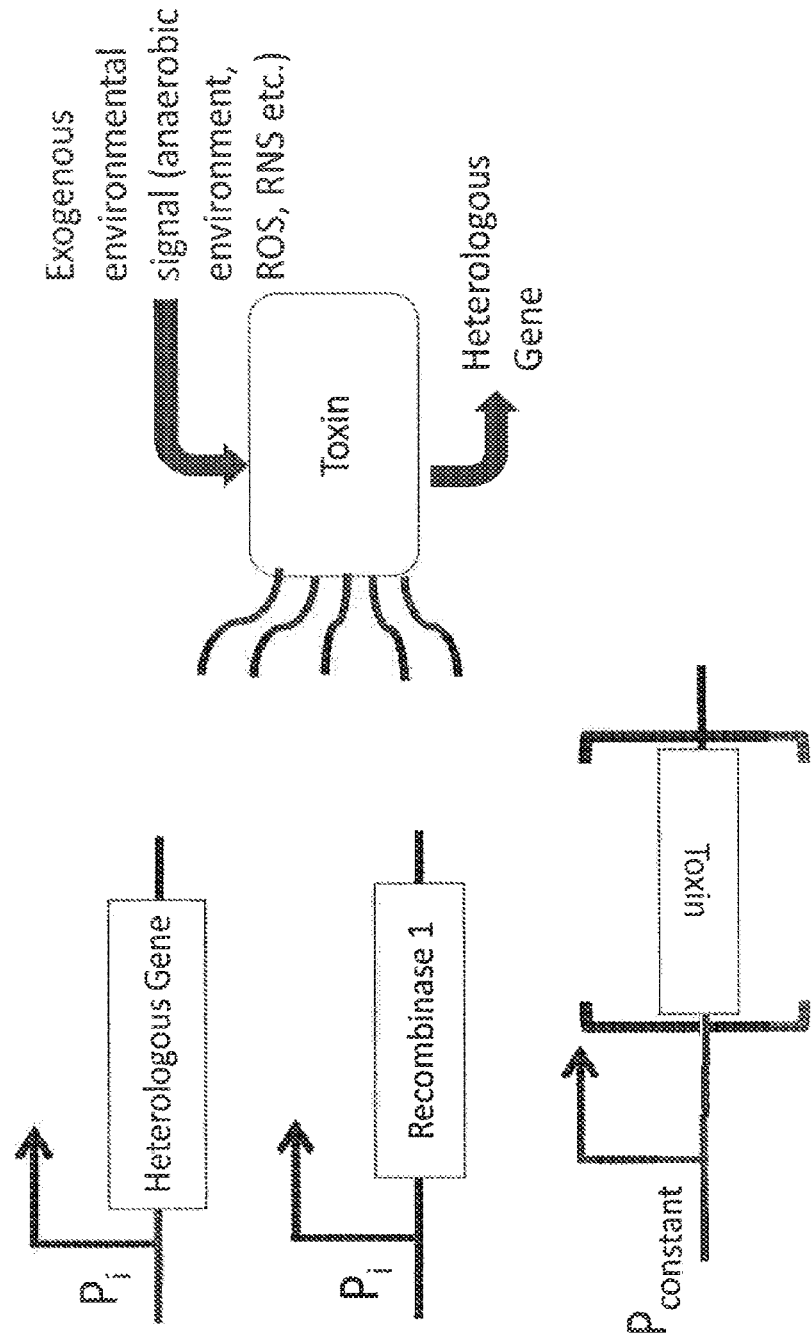
FIG. 57 depicts one non-limiting embodiment of the disclosure, where an exogenous environmental condition or one or more environmental signals activates expression of a heterologous gene and at least one recombinase from an inducible promoter or inducible promoters. The recombinase then flips a toxin gene into an activated conformation, and the natural kinetics of the recombinase create a time delay in expression of the toxin, allowing the heterologous gene to be fully expressed. Once the toxin is expressed, it kills the cell.
Figure 58:
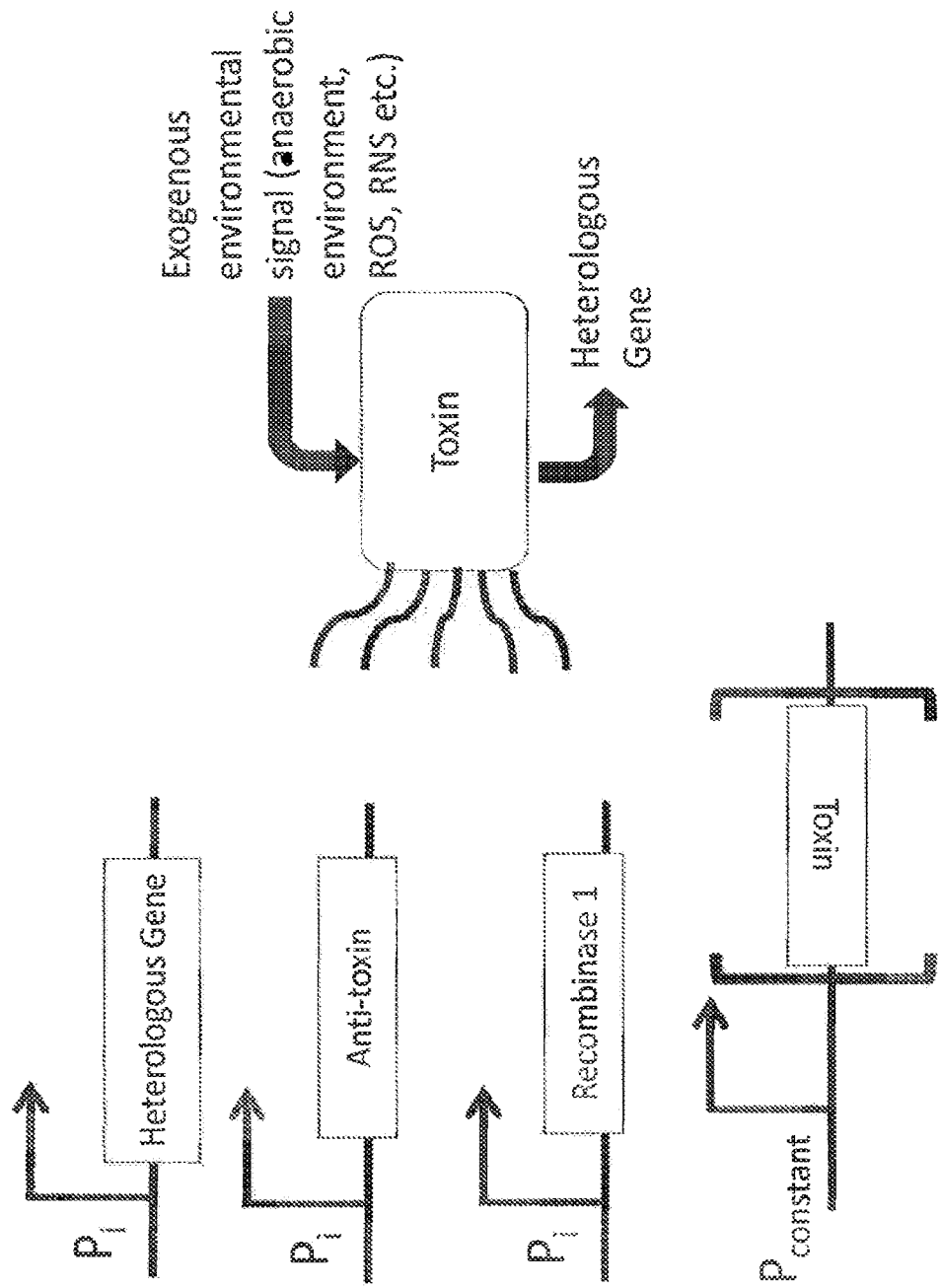
FIG. 58 depicts another non-limiting embodiment of the disclosure, where an exogenous environmental condition or one or more environmental signals activates expression of a heterologous gene, an anti-toxin, and at least one recombinase from an inducible promoter or inducible promoters. The recombinase then flips a toxin gene into an activated conformation, but the presence of the accumulated anti-toxin suppresses the activity of the toxin. Once the exogenous environmental condition or cue(s) is no longer present, expression of the anti-toxin is turned off. The toxin is constitutively expressed, continues to accumulate, and kills the bacterial cell.
Figure 59:
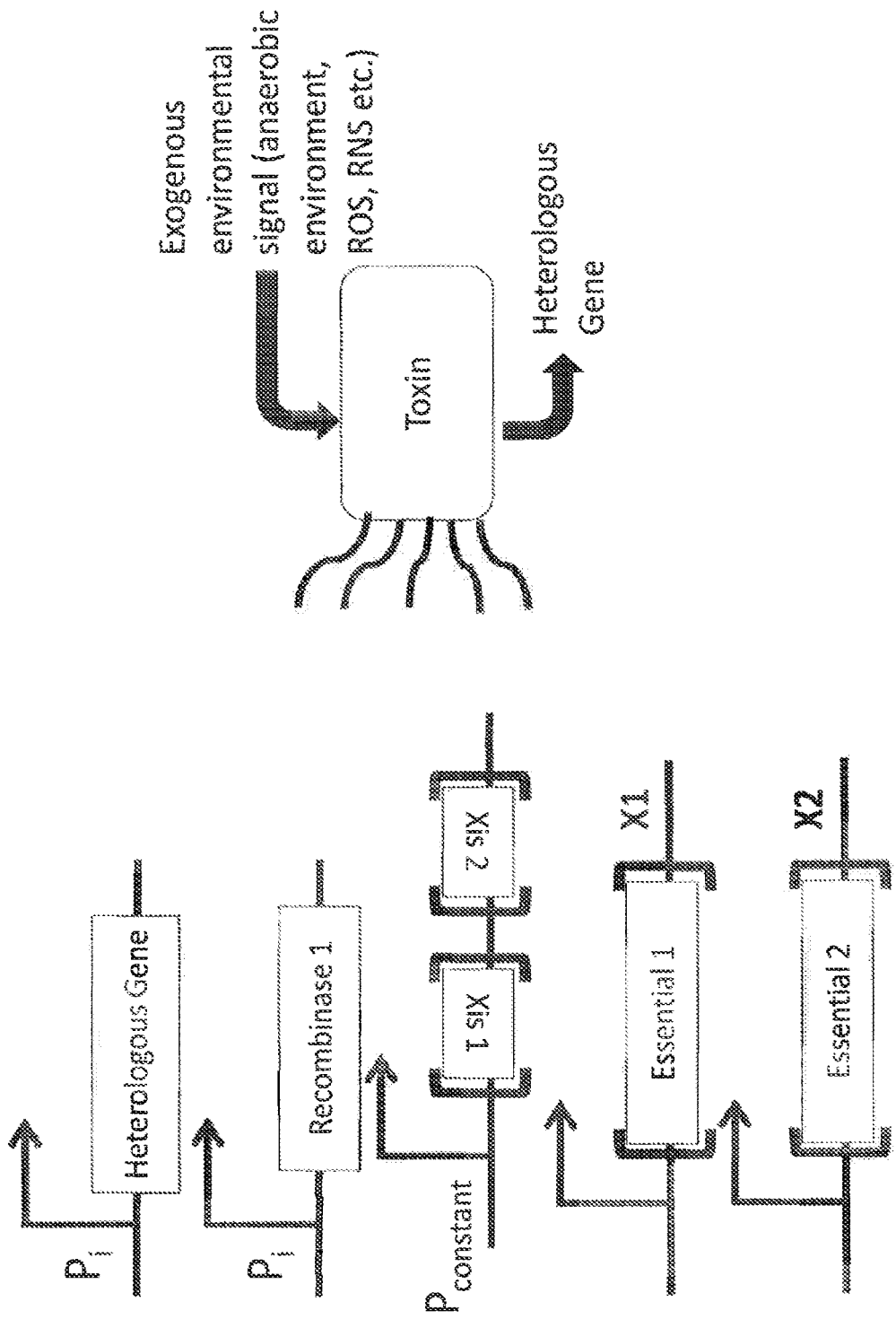
FIG. 59 depicts another non-limiting embodiment of the disclosure, where an exogenous environmental condition or one or more environmental signals activates expression of a heterologous gene and at least one recombinase from an inducible promoter or inducible promoters. The recombinase then flips at least one excision enzyme into an activated conformation. The at least one excision enzyme then excises one or more essential genes, leading to senescence, and eventual cell death. The natural kinetics of the recombinase and excision genes cause a time delay, the kinetics of which can be altered and optimized depending on the number and choice of essential genes to be excised, allowing cell death to occur within a matter of hours or days. The presence of multiple nested recombinases can be used to further control the timing of cell death.
Figure 60:
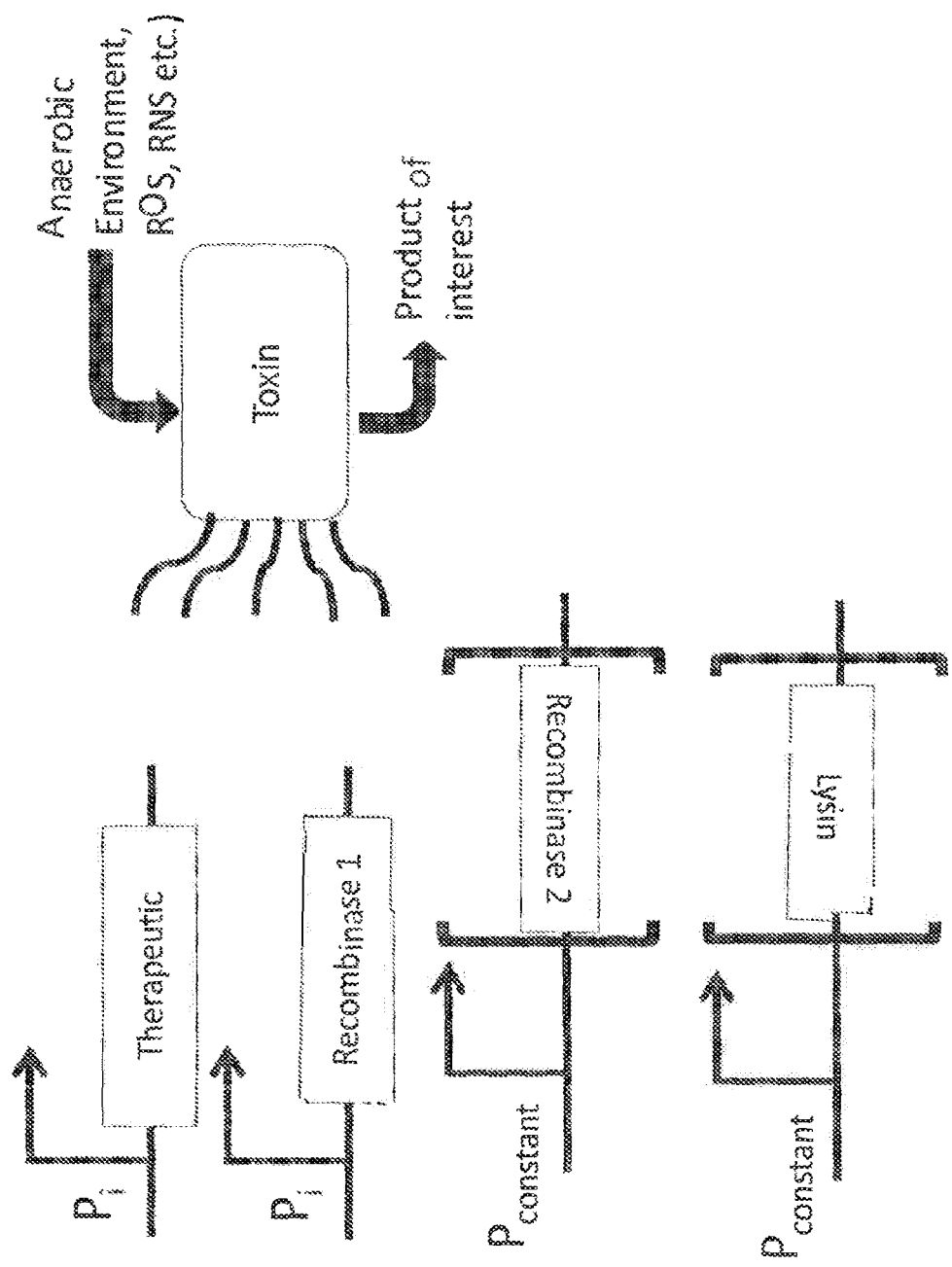
FIG. 60 depicts one non-limiting embodiment of the disclosure, where an exogenous environmental condition or one or more environmental signals activates expression of a heterologous gene and a first recombinase from an inducible promoter or inducible promoters. The recombinase then flips a second recombinase from an inverted orientation to an active conformation. The activated second recombinase flips the toxin gene into an activated conformation, and the natural kinetics of the recombinase create a time delay in expression of the toxin, allowing the heterologous gene to be fully expressed. Once the toxin is expressed, it kills the cell.
Figure 61:
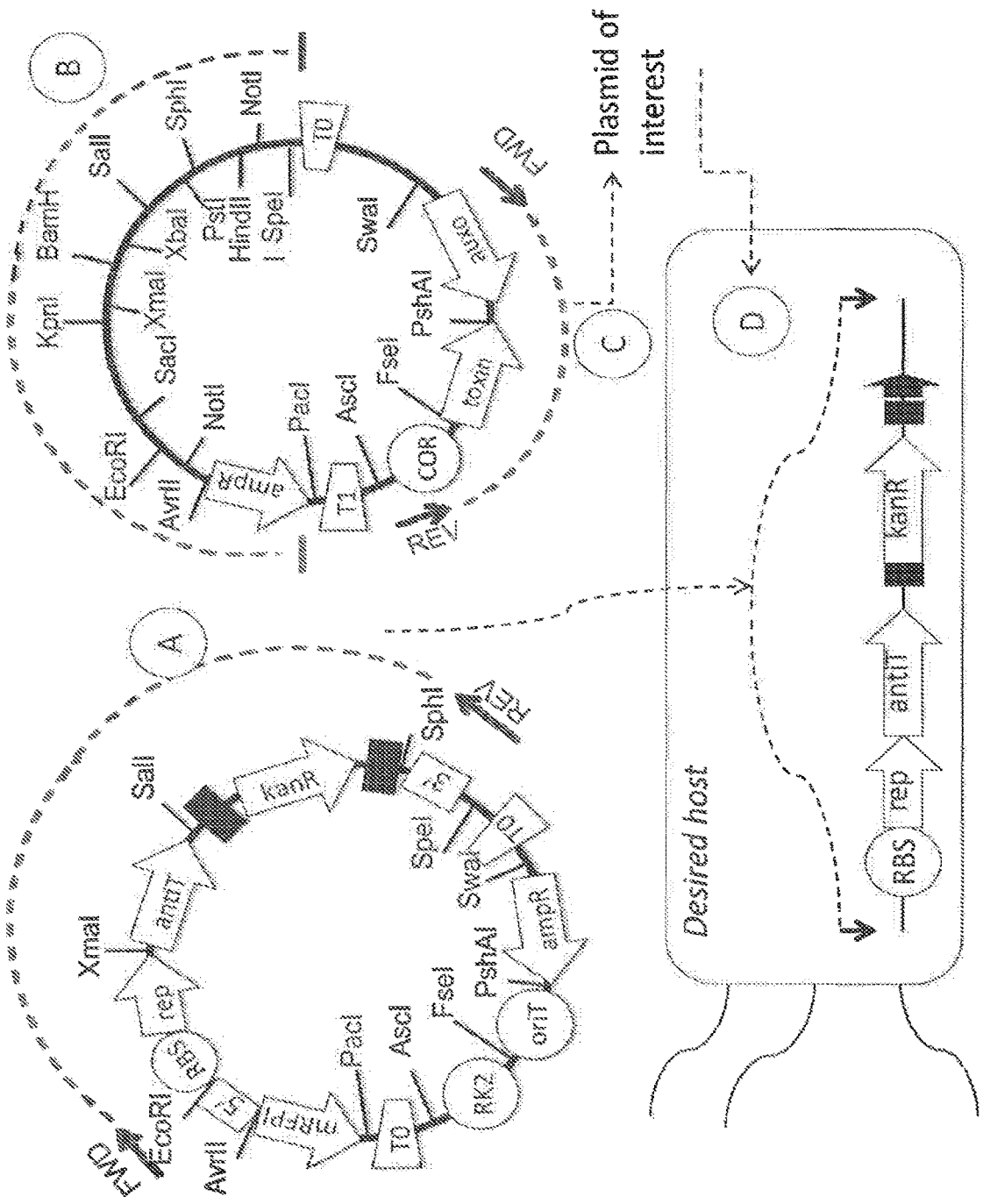
FIG. 61 depicts the use of GeneGuards as an engineered safety component. All engineered DNA is present on a plasmid which can be conditionally destroyed. See, e.g., Wright et al., "GeneGuard: A Modular Plasmid System Designed for Biosafety," ACS Synthetic Biology (2015) 4: 307-316.

In some embodiments, the genetically engineered bacterium is a conditional auxotroph whose essential gene(s) is replaced using the arabinose system shown in FIG. 56.

In some embodiments, the genetically engineered bacterium of the disclosure is an auxotroph and also comprises kill-switch circuitry, such as any of the kill-switch components and systems described herein. For example, the genetically engineered bacteria may comprise a deletion or mutation in an essential gene required for cell survival and/or growth, for example, in a DNA synthesis gene, for example, thyA, cell wall synthesis gene, for example, dapA and/or an amino acid gene, for example, serA or MetA and may also comprise a toxin gene that is regulated by one or more transcriptional activators that are expressed in response to an environmental condition(s) and/or signal(s) (such as the described arabinose system) or regulated by one or more recombinases that are expressed upon sensing an exogenous environmental condition(s) and/or signal(s) (such as the recombinase systems described herein). Other embodiments are described in Wright et al., "GeneGuard: A Modular Plasmid System Designed for Biosafety," ACS Synthetic Biology (2015) 4: 307-16, the entire contents of which are expressly incorporated herein by reference). In some embodiments, the genetically engineered bacterium of the disclosure is an auxotroph and also comprises kill-switch circuitry, such as any of the kill-switch components and systems described herein, as well as another biosecurity system, such a conditional origin of replication (Wright et al., 2015). In other embodiments, auxotrophic modifications may also be used to screen for mutant bacteria that produce the metabolic or satiety effector molecule.

Genetic Regulatory Circuits

In some embodiments, the genetically engineered bacteria comprise multi-layered genetic regulatory circuits for expressing the constructs described herein (see, e.g., U.S. Provisional Application No. 62/184,811, incorporated herein by reference in its entirety). The genetic regulatory circuits are useful to screen for mutant bacteria that produce a metabolic or satiety effector molecule or rescue an auxotroph. In certain embodiments, the invention provides methods for selecting genetically engineered bacteria that produce one or more genes of interest.

In some embodiments, the invention provides genetically engineered bacteria comprising a gene or gene cassette for producing a metabolic or satiety effector molecule and a T7 polymerase-regulated genetic regulatory circuit. For example, the genetically engineered bacteria comprise a first gene encoding a T7 polymerase, wherein the first gene is operably linked to a fumarate and nitrate reductase regulator (FNR)-responsive promoter; a second gene or gene cassette for producing a metabolic or satiety effector molecule, wherein the second gene or gene cassette is operably linked to a T7 promoter that is induced by the T7 polymerase; and a third gene encoding an inhibitory factor, lysY, that is capable of inhibiting the T7 polymerase. In the presence of oxygen, FNR does not bind the FNR-responsive promoter, and the metabolic or satiety effector molecule is not expressed. LysY is expressed constitutively (P-lac constitutive) and further inhibits T7 polymerase. In the absence of oxygen, FNR dimerizes and binds to the FNR-responsive promoter, T7 polymerase is expressed at a level sufficient to overcome lysY inhibition, and the metabolic or satiety effector molecule is expressed. In some embodiments, the lysY gene is operably linked to an additional FNR binding site. In the absence of oxygen, FNR dimerizes to activate T7 polymerase expression as described above, and also inhibits lysY expression.

In some embodiments, the invention provides genetically engineered bacteria comprising a gene or gene cassette for producing a metabolic or satiety effector molecule and a protease-regulated genetic regulatory circuit. For example, the genetically engineered bacteria comprise a first gene encoding an mf-lon protease, wherein the first gene is operably linked to a FNR-responsive promoter; a second gene or gene cassette for producing a metabolic or satiety effector molecule operably linked to a tet regulatory region (tetO); and a third gene encoding an mf-lon degradation signal linked to a tet repressor (tetR), wherein the tetR is capable of binding to the tet regulatory region and repressing expression of the second gene or gene cassette. The mf-lon protease is capable of recognizing the mf-lon degradation signal and degrading the tetR. In the presence of oxygen, FNR does not bind the FNR-responsive promoter, the repressor is not degraded, and the metabolic or satiety effector molecule is not expressed. In the absence of oxygen, FNR dimerizes and binds the FNR-responsive promoter, thereby inducing expression of mf-lon protease. The mf-lon protease recognizes the mf-lon degradation signal and degrades the tetR, and the metabolic or satiety effector molecule is expressed.

In some embodiments, the invention provides genetically engineered bacteria comprising a gene or gene cassette for producing a metabolic or satiety effector molecule and a repressor-regulated genetic regulatory circuit. For example, the genetically engineered bacteria comprise a first gene encoding a first repressor, wherein the first gene is operably linked to a FNR-responsive promoter; a second gene or gene cassette for producing a metabolic or satiety effector molecule operably linked to a first regulatory region comprising a constitutive promoter; and a third gene encoding a second repressor, wherein the second repressor is capable of binding to the first regulatory region and repressing expression of the second gene or gene cassette. The third gene is operably linked to a second regulatory region comprising a constitutive promoter, wherein the first repressor is capable of binding to the second regulatory region and inhibiting expression of the second repressor. In the presence of oxygen, FNR does not bind the FNR-responsive promoter, the first repressor is not expressed, the second repressor is expressed, and the metabolic or satiety effector molecule is not expressed. In the absence of oxygen, FNR dimerizes and binds the FNR-responsive promoter, the first repressor is expressed, the second repressor is not expressed, and the metabolic or satiety effector molecule is expressed.

Examples of repressors useful in these embodiments include, but are not limited to, ArgR, TetR, ArsR, AscG, LacI, CscR, DeoR, DgoR, FruR, GalR, GatR, CI, LexA, RafR, QacR, and PtxS (US20030166191).

In some embodiments, the invention provides genetically engineered bacteria comprising a gene or gene cassette for producing a metabolic or satiety effector molecule and a regulatory RNA-regulated genetic regulatory circuit. For example, the genetically engineered bacteria comprise a first gene encoding a regulatory RNA, wherein the first gene is operably linked to a FNR-responsive promoter, and a second gene or gene cassette for producing a metabolic or satiety effector molecule. The second gene or gene cassette is operably linked to a constitutive promoter and further linked to a nucleotide sequence capable of producing an mRNA hairpin that inhibits translation of the metabolic or satiety effector molecule. The regulatory RNA is capable of eliminating the mRNA hairpin and inducing translation via the ribosomal binding site. In the presence of oxygen, FNR does not bind the FNR-responsive promoter, the regulatory RNA is not expressed, and the mRNA hairpin prevents the metabolic or satiety effector molecule from being translated. In the absence of oxygen, FNR dimerizes and binds the FNR-responsive promoter, the regulatory RNA is expressed, the mRNA hairpin is eliminated, and the metabolic or satiety effector molecule is expressed.

In some embodiments, the invention provides genetically engineered bacteria comprising a gene or gene cassette for producing a metabolic or satiety effector molecule and a CRISPR-regulated genetic regulatory circuit. For example, the genetically engineered bacteria comprise a Cas9 protein; a first gene encoding a CRISPR guide RNA, wherein the first gene is operably linked to a FNR-responsive promoter; a second gene or gene cassette for producing a metabolic or satiety effector molecule, wherein the second gene or gene cassette is operably linked to a regulatory region comprising a constitutive promoter; and a third gene encoding a repressor operably linked to a constitutive promoter, wherein the repressor is capable of binding to the regulatory region and repressing expression of the second gene or gene cassette. The third gene is further linked to a CRISPR target sequence that is capable of binding to the CRISPR guide RNA, wherein said binding to the CRISPR guide RNA induces cleavage by the Cas9 protein and inhibits expression of the repressor. In the presence of oxygen, FNR does not bind the FNR-responsive promoter, the guide RNA is not expressed, the repressor is expressed, and the metabolic or satiety effector molecule is not expressed. In the absence of oxygen, FNR dimerizes and binds the FNR-responsive promoter, the guide RNA is expressed, the repressor is not expressed, and the metabolic or satiety effector molecule is expressed.

In some embodiments, the invention provides genetically engineered bacteria comprising a gene or gene cassette for producing a metabolic or satiety effector molecule and a recombinase-regulated genetic regulatory circuit. For example, the genetically engineered bacteria comprise a first gene encoding a recombinase, wherein the first gene is operably linked to a FNR-responsive promoter, and a second gene or gene cassette for producing a metabolic or satiety effector molecule operably linked to a constitutive promoter. The second gene or gene cassette is inverted in orientation (3' to 5') and flanked by recombinase binding sites, and the recombinase is capable of binding to the recombinase binding sites to induce expression of the second gene or gene cassette by reverting its orientation (5' to 3'). In the presence of oxygen, FNR does not bind the FNR-responsive promoter, the recombinase is not expressed, the gene or gene cassette remains in the 3' to 5' orientation, and no functional metabolic or satiety effector molecule is produced. In the absence of oxygen, FNR dimerizes and binds the FNR-responsive promoter, the recombinase is expressed, the gene or gene cassette is reverted to the 5' to 3' orientation, and functional metabolic or satiety effector molecule is produced.

In some embodiments, the invention provides genetically engineered bacteria comprising a gene or gene cassette for producing a metabolic or satiety effector molecule and a polymerase- and recombinase-regulated genetic regulatory circuit. For example, the genetically engineered bacteria comprise a first gene encoding a recombinase, wherein the first gene is operably linked to a FNR-responsive promoter; a second gene or gene cassette for producing a metabolic or satiety effector molecule operably linked to a T7 promoter; a third gene encoding a T7 polymerase, wherein the T7 polymerase is capable of binding to the T7 promoter and inducing expression of the metabolic or satiety effector molecule. The third gene encoding the T7 polymerase is inverted in orientation (3' to 5') and flanked by recombinase binding sites, and the recombinase is capable of binding to the recombinase binding sites to induce expression of the T7 polymerase gene by reverting its orientation (5' to 3'). In the presence of oxygen, FNR does not bind the FNR-responsive promoter, the recombinase is not expressed, the T7 polymerase gene remains in the 3' to 5' orientation, and the metabolic or satiety effector molecule is not expressed. In the absence of oxygen, FNR dimerizes and binds the FNR-responsive promoter, the recombinase is expressed, the T7 polymerase gene is reverted to the 5' to 3' orientation, and the metabolic or satiety effector molecule is expressed.

Host-Plasmid Mutual Dependency

In some embodiments, the genetically engineered bacteria of the invention also comprise a plasmid that has been modified to create a host-plasmid mutual dependency. In certain embodiments, the mutually dependent host-plasmid platform is GeneGuard (Wright et al., 2015). In some embodiments, the GeneGuard plasmid comprises (i) a conditional origin of replication, in which the requisite replication initiator protein is provided in trans; (ii) an auxotrophic modification that is rescued by the host via genomic translocation and is also compatible for use in rich media; and/or (iii) a nucleic acid sequence which encodes a broad-spectrum toxin. The toxin gene may be used to select against plasmid spread by making the plasmid DNA itself disadvantageous for strains not expressing the anti-toxin (e.g., a wild-type bacterium). In some embodiments, the GeneGuard plasmid is stable for at least 100 generations without antibiotic selection. In some embodiments, the GeneGuard plasmid does not disrupt growth of the host. The GeneGuard plasmid is used to greatly reduce unintentional plasmid propagation in the genetically engineered bacteria of the invention.

The mutually dependent host-plasmid platform may be used alone or in combination with other biosafety mechanisms, such as those described herein (e.g., kill switches, auxotrophies). In some embodiments, the genetically engineered bacteria comprise a GeneGuard plasmid. In other embodiments, the genetically engineered bacteria comprise a GeneGuard plasmid and/or one or more kill switches. In other embodiments, the genetically engineered bacteria comprise a GeneGuard plasmid and/or one or more auxotrophies. In still other embodiments, the genetically engineered bacteria comprise a GeneGuard plasmid, one or more kill switches, and/or one or more auxotrophies.

Synthetic gene circuits express on plasmids may function well in the short term but lose ability and/or function in the long term (Danino et al., 2015). In some embodiments, the genetically engineered bacteria comprise stable circuits for expressing genes of interest over prolonged periods. In some embodiments, the genetically engineered bacteria are capable of producing a metabolic or satiety effector molecule and further comprise a toxin-antitoxin system that simultaneously produces a toxin (hok) and a short-lived antitoxin (sok), wherein loss of the plasmid causes the cell to be killed by the long-lived toxin (Danino et al., 2015; FIG. 29). In some embodiments, the genetically engineered bacteria further comprise alp7 from *B. subtilis* plasmid pL20 and produces filaments that are capable of pushing plasmids to the poles of the cells in order to ensure equal segregation during cell division (Danino et al., 2015).

Kill Switch

In some embodiments, the genetically engineered bacteria of the invention also comprise a kill switch (see, e.g., U.S. Provisional Application Nos. 62/183,935 and 62/263,329, incorporated herein by reference in their entireties). The kill switch is intended to actively kill genetically engineered bacteria in response to external stimuli. As opposed to an auxotrophic mutation where bacteria die because they lack an essential nutrient for survival, the kill switch is triggered by a particular factor in the environment that induces the production of toxic molecules within the microbe that cause cell death.

Bacteria comprising kill switches have been engineered for in vitro research purposes, e.g., to limit the spread of a biofuel-producing microorganism outside of a laboratory environment. Bacteria engineered for in vivo administration to treat a disease may also be programmed to die at a specific time after the expression and delivery of a heterologous gene or genes, for example, a metabolic or satiety effector molecule, or after the subject has experienced the therapeutic effect. For example, in some embodiments, the kill switch is activated to kill the bacteria after a period of time following oxygen level-dependent expression of the metabolic or satiety effector molecule, e.g., GLP-1. In some embodiments, the kill switch is activated in a delayed fashion following oxygen level-dependent expression of the metabolic or satiety effector molecule. Alternatively, the bacteria may be engineered to die after the bacterium has spread outside of a disease site. Specifically, it may be useful to prevent long-term colonization of subjects by the microorganism, spread of the microorganism outside the area of interest (for example, outside the gut) within the subject, or spread of the microorganism outside of the subject into the environment (for example, spread to the environment through the stool of the subject). Examples of such toxins that can be used in kill-switches include, but are not limited to, bacteriocins, lysins, and other molecules that cause cell death by lysing cell membranes, degrading cellular DNA, or other mechanisms. Such toxins can be used individually or in combination. The switches that control their production can be based on, for example, transcriptional activation (toggle switches; see, e.g., Gardner et al., 2000), translation (riboregulators), or DNA recombination (recombinase-based switches), and can sense environmental stimuli such as anaerobiosis or reactive oxygen species. These switches can be activated by a single environmental factor or may require several activators in AND, OR, NAND and NOR logic configurations to induce cell death. For example, an AND riboregulator switch is activated by tetracycline, isopropyl β-D-1-thiogalactopyranoside (IPTG), and arabinose to induce the expression of lysins, which permeabilize the cell membrane and kill the cell. IPTG induces the expression of the endolysin and holin mRNAs, which are then derepressed by the addition of arabinose and tetracycline. All three inducers must be present to cause cell death. Examples of kill switches are known in the art (Callura et al., 2010).

Kill-switches can be designed such that a toxin is produced in response to an environmental condition or external signal (e.g., the bacteria is killed in response to an external cue) or, alternatively designed such that a toxin is produced once an environmental condition no longer exists or an external signal is ceased.

Thus, in some embodiments, the genetically engineered bacteria of the disclosure are further programmed to die after sensing an exogenous environmental signal, for example, in a low-oxygen environment. In some embodiments, the genetically engineered bacteria of the present disclosure comprise one or more genes encoding one or more recombinase(s), whose expression is induced in response to an environmental condition or signal and causes one or more recombination events that ultimately leads to the expression of a toxin which kills the cell. In some embodiments, the at least one recombination event is the flipping of an inverted heterologous gene encoding a bacterial toxin which is then constitutively expressed after it is flipped by the first recombinase. In one embodiment, constitutive expression of the bacterial toxin kills the genetically engineered bacterium. In these types of kill-switch systems once the engineered bacterial cell senses the exogenous environmental condition and expresses the heterologous gene of interest, the recombinant bacterial cell is no longer viable.

In another embodiment in which the genetically engineered bacteria of the present disclosure express one or more recombinase(s) in response to an environmental condition or signal causing at least one recombination event, the genetically engineered bacterium further expresses a heterologous gene encoding an anti-toxin in response to an exogenous environmental condition or signal. In one embodiment, the at least one recombination event is flipping of an inverted heterologous gene encoding a bacterial toxin by a first recombinase. In one embodiment, the inverted heterologous gene encoding the bacterial toxin is located between a first forward recombinase recognition sequence and a first reverse recombinase recognition sequence. In one embodiment, the heterologous gene encoding the bacterial toxin is constitutively expressed after it is flipped by the first recombinase. In one embodiment, the anti-toxin inhibits the activity of the toxin, thereby delaying death of the genetically engineered bacterium. In one embodiment, the genetically engineered bacterium is killed by the bacterial toxin when the heterologous gene encoding the anti-toxin is no longer expressed when the exogenous environmental condition is no longer present.

In another embodiment, the at least one recombination event is flipping of an inverted heterologous gene encoding a second recombinase by a first recombinase, followed by the flipping of an inverted heterologous gene encoding a bacterial toxin by the second recombinase. In one embodiment, the inverted heterologous gene encoding the second recombinase is located between a first forward recombinase recognition sequence and a first reverse recombinase recognition sequence. In one embodiment, the inverted heterologous gene encoding the bacterial toxin is located between a second forward recombinase recognition sequence and a second reverse recombinase recognition sequence. In one embodiment, the heterologous gene encoding the second recombinase is constitutively expressed after it is flipped by the first recombinase. In one embodiment, the heterologous gene encoding the bacterial toxin is constitutively expressed after it is flipped by the second recombinase. In one embodiment, the genetically engineered bacterium is killed by the bacterial toxin. In one embodiment, the genetically engineered bacterium further expresses a heterologous gene encoding an anti-toxin in response to the exogenous environmental condition. In one embodiment, the anti-toxin inhibits the activity of the toxin when the exogenous environmental condition is present, thereby delaying death of the genetically engineered bacterium. In one embodiment, the genetically engineered bacterium is killed by the bacterial toxin when the heterologous gene encoding the anti-toxin is no longer expressed when the exogenous environmental condition is no longer present.

In one embodiment, the at least one recombination event is flipping of an inverted heterologous gene encoding a second recombinase by a first recombinase, followed by flipping of an inverted heterologous gene encoding a third recombinase by the second recombinase, followed by flipping of an inverted heterologous gene encoding a bacterial toxin by the third recombinase.

In one embodiment, the at least one recombination event is flipping of an inverted heterologous gene encoding a first excision enzyme by a first recombinase. In one embodiment, the inverted heterologous gene encoding the first excision enzyme is located between a first forward recombinase recognition sequence and a first reverse recombinase recognition sequence. In one embodiment, the heterologous gene encoding the first excision enzyme is constitutively expressed after it is flipped by the first recombinase. In one embodiment, the first excision enzyme excises a first essential gene. In one embodiment, the programmed recombinant bacterial cell is not viable after the first essential gene is excised.

In one embodiment, the first recombinase further flips an inverted heterologous gene encoding a second excision enzyme. In one embodiment, the inverted heterologous gene encoding the second excision enzyme is located between a second forward recombinase recognition sequence and a second reverse recombinase recognition sequence. In one embodiment, the heterologous gene encoding the second excision enzyme is constitutively expressed after it is flipped by the first recombinase. In one embodiment, the genetically engineered bacterium dies or is no longer viable when the first essential gene and the second essential gene are both excised. In one embodiment, the genetically engineered bacterium dies or is no longer viable when either the first essential gene is excised or the second essential gene is excised by the first recombinase.

In one embodiment, the genetically engineered bacterium dies after the at least one recombination event occurs. In another embodiment, the genetically engineered bacterium is no longer viable after the at least one recombination event occurs.

In any of these embodiment, the recombinase can be a recombinase selected from the group consisting of: BxbI, PhiC31, TP901, BxbI, PhiC31, TP901, HK022, HP1, R4, Int1, Int2, Int3, Int4, Int5, Int6, Int7, Int8, Int9, Int10, Int11, Int12, Int13, Int14, Int15, Int16, Int17, Int18, Int19, Int20, Int21, Int22, Int23, Int24, Int25, Int26, Int27, Int28, Int29, Int30, Int31, Int32, Int33, and Int34, or a biologically active fragment thereof.

In the above-described kill-switch circuits, a toxin is produced in the presence of an environmental factor or signal. In another aspect of kill-switch circuitry, a toxin may be repressed in the presence of an environmental factor (not produced) and then produced once the environmental condition or external signal is no longer present. Such kill switches are called repression-based kill switches and represent systems in which the bacterial cells are viable only in the presence of an external factor or signal, such as arabinose or other sugar. Exemplary kill switch designs in which the toxin is repressed in the presence of an external factor or signal (and activated once the external signal is removed) is shown in FIGS. 56-61. The disclosure provides recombinant bacterial cells which express one or more heterologous gene(s) upon sensing arabinose or other sugar in the exogenous environment. In this aspect, the recombinant bacterial cells contain the araC gene, which encodes the AraC transcription factor, as well as one or more genes under the control of the araBAD promoter. In the absence of arabinose, the AraC transcription factor adopts a conformation that represses transcription of genes under the control of the araBAD promoter. In the presence of arabinose, the AraC transcription factor undergoes a conformational change that allows it to bind to and activate the AraBAD promoter, which induces expression of the desired gene, for example tetR, which represses expression of a toxin gene. In this embodiment, the toxing gene is repressed in the presence of arabinose or other sugar. In an environment where arabinose is not present, the tetR gene is not activated and the toxin is expressed, thereby killing the bacteria. The arbinoase system can also be used to express an essential gene, in which the essential gene is only expressed in the presence of arabinose or other sugar and is not expressed when arabinose or other sugar is absent from the environment.

Thus, in some embodiments in which one or more heterologous gene(s) are expressed upon sensing arabinose in the exogenous environment, the one or more heterologous genes are directly or indirectly under the control of the araBAD promoter. In some embodiments, the expressed heterologous gene is selected from one or more of the following: a heterologous therapeutic gene, a heterologous gene encoding an antitoxin, a heterologous gene encoding a repressor protein or polypeptide, for example, a TetR repressor, a heterologous gene encoding an essential protein not found in the bacterial cell, and/or a heterologous encoding a regulatory protein or polypeptide.

Arabinose inducible promoters are known in the art, including $P_{ara}$, $P_{araB}$, $P_{araC}$, and $P_{araBAD}$. In one embodiment, the arabinose inducible promoter is from *E. coli*. In some embodiments, the $P_{araC}$ promoter and the $P_{araBAD}$ promoter operate as a bidirectional promoter, with the $P_{araBAD}$ promoter controlling expression of a heterologous gene(s) in one direction, and the $P_{araC}$ (in close proximity to, and on the opposite strand from the $P_{araBAD}$ promoter), controlling expression of a heterologous gene(s) in the other direction. In the presence of arabinose, transcription of both heterologous genes from both promoters is induced. However, in the absence of arabinose, transcription of both heterologous genes from both promoters is not induced.

In one exemplary embodiment of the disclosure, the genetically engineered bacteria of the present disclosure contains a kill-switch having at least the following sequences: a $P_{araBAD}$ promoter operably linked to a heterologous gene encoding a Tetracycline Repressor Protein (TetR), a $P_{araC}$ promoter operably linked to a heterologous gene encoding AraC transcription factor, and a heterologous gene encoding a bacterial toxin operably linked to a promoter which is repressed by the Tetracycline Repressor Protein ($P_{TetR}$). In the presence of arabinose, the AraC transcription factor activates the $P_{araBAD}$ promoter, which activates transcription of the TetR protein which, in turn, represses transcription of the toxin. In the absence of arabinose, however, AraC suppresses transcription from the $P_{araBAD}$ promoter and no TetR protein is expressed. In this case, expression of the heterologous toxin gene is activated, and the toxin is expressed. The toxin builds up in the recombinant bacterial cell, and the recombinant bacterial cell is killed. In one embodiment, the AraC gene encoding the AraC transcription factor is under the control of a constitutive promoter and is therefore constitutively expressed.

In one embodiment of the disclosure, the genetically engineered bacterium further comprises an antitoxin under the control of a constitutive promoter. In this situation, in the presence of arabinose, the toxin is not expressed due to repression by TetR protein, and the antitoxin protein builds-up in the cell. However, in the absence of arabinose, TetR protein is not expressed, and expression of the toxin is induced. The toxin begins to build-up within the recombinant bacterial cell. The recombinant bacterial cell is no longer viable once the toxin protein is present at either equal or greater amounts than that of the anti-toxin protein in the cell, and the recombinant bacterial cell will be killed by the toxin.

In another embodiment of the disclosure, the genetically engineered bacterium further comprises an antitoxin under the control of the $P_{araBAD}$ promoter. In this situation, in the presence of arabinose, TetR and the anti-toxin are expressed, the anti-toxin builds up in the cell, and the toxin is not expressed due to repression by TetR protein. However, in the absence of arabinose, both the TetR protein and the anti-toxin are not expressed, and expression of the toxin is induced. The toxin begins to build-up within the recombinant bacterial cell. The recombinant bacterial cell is no longer viable once the toxin protein is expressed, and the recombinant bacterial cell will be killed by the toxin.

In another exemplary embodiment of the disclosure, the genetically engineered bacteria of the present disclosure contains a kill-switch having at least the following sequences: a $P_{araBAD}$ promoter operably linked to a heterologous gene encoding an essential polypeptide not found in the recombinant bacterial cell (and required for survival), and a $P_{araC}$ promoter operably linked to a heterologous gene encoding AraC transcription factor. In the presence of arabinose, the AraC transcription factor activates the $P_{araBAD}$ promoter, which activates transcription of the heterologous gene encoding the essential polypeptide, allowing the recombinant bacterial cell to survive. In the absence of arabinose, however, AraC suppresses transcription from the the $P_{araBAD}$ promoter and the essential protein required for survival is not expressed. In this case, the recombinant bacterial cell dies in the absence of arabinose. In some embodiments, the sequence of $P_{araBAD}$ promoter operably linked to a heterologous gene encoding an essential polypeptide not found in the recombinant bacterial cell can be present in the bacterial cell in conjunction with the TetR/toxin kill-switch system described directly above. In some embodiments, the sequence of $P_{araBAD}$ promoter operably linked to a heterologous gene encoding an essential polypeptide not found in the recombinant bacterial cell can be present in the bacterial cell in conjunction with the TetR/toxin/anto-toxin kill-switch system described directly above.

In yet other embodiments, the bacteria may comprise a plasmid stability system with a plasmid that produces both a short-lived anti-toxin and a long-lived toxin. In this system, the bacterial cell produces equal amounts of toxin and anti-toxin to neutralize the toxin. However, if/when the cell loses the plasmid, the short-lived anti-toxin begins to decay. When the anti-toxin decays completely the cell dies as a result of the longer-lived toxin killing it.

In some embodiments, the engineered bacteria of the present disclosure further comprise the gene(s) encoding the components of any of the above-described kill-switch circuits.

In any of the above-described embodiments, the bacterial toxin is selected from the group consisting of a lysin, Hok, Fst, TisB, LdrD, Kid, SymE, MazF, FlmA, Ibs, XCV2162, dinJ, CcdB, MazF, ParE, YafO, Zeta, hicB, relB, yhaV, yoeB, chpBK, hipA, microcin B, microcin B17, microcin C, microcin C7-C51, microcin J25, microcin ColV, microcin 24, microcin L, microcin D93, microcin L, microcin E492, microcin H47, microcin 147, microcin M, colicin A, colicin E1, colicin K, colicin N, colicin U, colicin B, colicin Ia, colicin Ib, colicin 5, colicin10, colicin S4, colicin Y, colicin E2, colicin E7, colicin E8, colicin E9, colicin E3, colicin E4, colicin E6, colicin E5, colicin D, colicin M, and cloacin DF13, or a biologically active fragment thereof.

In any of the above-described embodiments, the antitoxin is selected from the group consisting of an anti-lysin, Sok, RNAII, IstR, RdlD, Kis, SymR, MazE, FlmB, Sib, ptaRNA1, yafQ, CcdA, MazE, ParD, yafN, Epsilon, HicA, relE, prlF, yefM, chpBI, hipB, MccE, MccE$^{CTD}$, MccF, Cai, ImmEl, Cki, Cni, Cui, Cbi, Iia, Imm, Cfi, Im10, Csi, Cyi, Im2, Im7, Im8, Im9, Im3, Im4, ImmE6, cloacin immunity protein (Cim), ImmES, ImmD, and Cmi, or a biologically active fragment thereof.

In one embodiment, the bacterial toxin is bactericidal to the genetically engineered bacterium. In one embodiment, the bacterial toxin is bacteriostatic to the genetically engineered bacterium.

In some embodiments, the genetically engineered bacterium provided herein is an auxotroph. In one embodiment, the genetically engineered bacterium is an auxotroph selected from a cysE, glnA, ilvD, leuB, lysA, serA, metA, glyA, hisB, ilvA, pheA, proA, thrC, trpC, tyrA, thyA, uraA, dapA, dapB, dapD, dapE, dapF, flhD, metB, metC, proAB, and thi1 auxotroph. In some embodiments, the engineered bacteria have more than one auxotrophy, for example, they may be a ΔthyA and ΔdapA auxotroph.

In some embodiments, the genetically engineered bacterium provided herein further comprises a kill-switch circuit, such as any of the kill-switch circuits provided herein. For example, in some embodiments, the genetically engineered bacteria further comprise one or more genes encoding one or more recombinase(s) under the control of an inducible promoter and an inverted toxin sequence. In some embodiments, the genetically engineered bacteria further comprise one or more genes encoding an antitoxin. In some embodiments, the engineered bacteria further comprise one or more genes encoding one or more recombinase(s) under the control of an inducible promoter and one or more inverted excision genes, wherein the excision gene(s) encode an enzyme that deletes an essential gene. In some embodiments, the genetically engineered bacteria further comprise one or more genes encoding an antitoxin. In some embodiments, the engineered bacteria further comprise one or more genes encoding a toxin under the control of a promoter having a TetR repressor binding site and a gene encoding the TetR under the control of an inducible promoter that is induced by arabinose, such as ParaBAD. In some embodiments, the genetically engineered bacteria further comprise one or more genes encoding an antitoxin.

In some embodiments, the genetically engineered bacterium is an auxotroph comprising a therapeutic payload and further comprises a kill-switch circuit, such as any of the kill-switch circuits described herein.

In some embodiments of the above described genetically engineered bacteria, the gene or gene cassette for producing the metabolic or satiety effector molecule is present on a plasmid in the bacterium and operatively linked on the plasmid to the promoter that is induced under low-oxygen or anaerobic conditions. In other embodiments, the gene or gene cassette for producing the metabolic or satiety effector molecule is present in the bacterial chromosome and is operatively linked in the chromosome to the promoter that is induced under low-oxygen or anaerobic conditions.

Pharmaceutical Compositions and Formulations

Pharmaceutical compositions comprising the genetically engineered bacteria of the invention may be used to treat, manage, ameliorate, and/or prevent a metabolic disease, e.g., obesity, type 2 diabetes. Pharmaceutical compositions of the invention comprising one or more genetically engineered bacteria, alone or in combination with prophylactic agents, therapeutic agents, and/or and pharmaceutically acceptable carriers are provided.

In certain embodiments, the pharmaceutical composition comprises one species, strain, or subtype of bacteria described herein that are engineered to treat, manage, ameliorate, and/or prevent a metabolic disease. In alternate embodiments, the pharmaceutical composition comprises two or more species, strains, and/or subtypes of bacteria described herein that are each engineered to treat, manage, ameliorate, and/or prevent a metabolic disease.

The pharmaceutical compositions of the invention may be formulated in a conventional manner using one or more physiologically acceptable carriers comprising excipients and auxiliaries, which facilitate processing of the active ingredients into compositions for pharmaceutical use. Methods of formulating pharmaceutical compositions are known in the art (see, e.g., "Remington's Pharmaceutical Sciences," Mack Publishing Co., Easton, Pa.). In some embodiments, the pharmaceutical compositions are subjected to tabletting, lyophilizing, direct compression, conventional mixing, dissolving, granulating, levigating, emulsifying, encapsulating, entrapping, or spray drying to form tablets, granulates, nanoparticles, nanocapsules, microcapsules, microtablets, pellets, or powders, which may be enterically coated or uncoated. Appropriate formulation depends on the route of administration.

The genetically engineered bacteria of the invention may be formulated into pharmaceutical compositions in any suitable dosage form (e.g., liquids, capsules, sachet, hard capsules, soft capsules, tablets, enteric coated tablets, suspension powders, granules, or matrix sustained release formations for oral administration) and for any suitable type of administration (e.g., oral, topical, immediate-release, pulsatile-release, delayed-release, or sustained release). Suitable dosage amounts for the genetically engineered bacteria may range from about $10^5$ to $10^{12}$ bacteria, e.g., approximately $10^5$ bacteria, approximately $10^6$ bacteria, approximately $10^7$ bacteria, approximately $10^8$ bacteria, approximately $10^9$ bacteria, approximately $10^{10}$ bacteria, approximately $10^{11}$ bacteria, or approximately $10^{11}$ bacteria. The composition may be administered once or more daily, weekly, or monthly. The genetically engineered bacteria may be formulated into pharmaceutical compositions comprising one or more pharmaceutically acceptable carriers, thickeners, diluents, buffers, surface active agents, neutral or cationic lipids, lipid complexes, liposomes, penetration enhancers, carrier compounds, and other pharmaceutically acceptable carriers or agents.

The genetically engineered bacteria of the invention may be administered topically and formulated in the form of an ointment, cream, transdermal patch, lotion, gel, shampoo, spray, aerosol, solution, emulsion, or other form well-known to one of skill in the art. See, e.g., "Remington's Pharmaceutical Sciences," Mack Publishing Co., Easton, Pa. In an embodiment, for non-sprayable topical dosage forms, viscous to semi-solid or solid forms comprising a carrier or one or more excipients compatible with topical application and having a dynamic viscosity greater than water are employed. Suitable formulations include, but are not limited to, solutions, suspensions, emulsions, creams, ointments, powders, liniments, salves, etc., which may be sterilized or mixed with auxiliary agents (e.g., preservatives, stabilizers, wetting agents, buffers, or salts) for influencing various properties, e.g., osmotic pressure. Other suitable topical dosage forms include sprayable aerosol preparations wherein the active ingredient in combination with a solid or liquid inert carrier, is packaged in a mixture with a pressurized volatile (e.g., a gaseous propellant, such as freon) or in a squeeze bottle. Moisturizers or humectants can also be added to pharmaceutical compositions and dosage forms. Examples of such additional ingredients are well known in the art.

The genetically engineered bacteria of the invention may be administered orally and formulated as tablets, pills, dragees, capsules, liquids, gels, syrups, slurries, suspensions, etc. Pharmacological compositions for oral use can be made using a solid excipient, optionally grinding the resulting mixture, and processing the mixture of granules, after adding suitable auxiliaries if desired, to obtain tablets or dragee cores. Suitable excipients include, but are not limited to, fillers such as sugars, including lactose, sucrose, mannitol, or sorbitol; cellulose compositions such as maize starch, wheat starch, rice starch, potato starch, gelatin, gum tragacanth, methyl cellulose, hydroxypropylmethyl-cellulose, sodium carbomethylcellulose; and/or physiologically acceptable polymers such as polyvinylpyrrolidone (PVP) or polyethylene glycol (PEG). Disintegrating agents may also be added, such as cross-linked polyvinylpyrrolidone, agar, alginic acid or a salt thereof such as sodium alginate.

Tablets or capsules can be prepared by conventional means with pharmaceutically acceptable excipients such as binding agents (e.g., pregelatinised maize starch, polyvinylpyrrolidone, hydroxypropyl methylcellulose, carboxymethylcellulose, polyethylene glycol, sucrose, glucose, sorbitol, starch, gum, kaolin, and tragacanth); fillers (e.g., lactose, microcrystalline cellulose, or calcium hydrogen phosphate); lubricants (e.g., calcium, aluminum, zinc, stearic acid, polyethylene glycol, sodium lauryl sulfate, starch, sodium benzoate, L-leucine, magnesium stearate, talc, or silica); disintegrants (e.g., starch, potato starch, sodium starch glycolate, sugars, cellulose derivatives, silica powders); or wetting agents (e.g., sodium lauryl sulphate). The tablets may be coated by methods well known in the art. A coating shell may be present, and common membranes include, but are not limited to, polylactide, polyglycolic acid, polyanhydride, other biodegradable polymers, alginate-polylysine-alginate (APA), alginate-polymethylene-co-guanidine-alginate (A-PMCG-A), hydroymethylacrylate-methyl methacrylate (HEMA-MMA), multilayered HEMA-MMA-MAA, polyacrylonitrilevinylchloride (PAN-PVC), acrylonitrile/sodium methallylsulfonate (AN-69), polyethylene glycol/poly pentamethylcyclopentasiloxane/polydimethylsiloxane (PEG/PD5/PDMS), poly N,N-dimethyl acrylamide (PDMAAm), siliceous encapsulates, cellulose sulphate/sodium alginate/polymethylene-co-guanidine (CS/A/PMCG), cellulose acetate phthalate, calcium alginate, k-carrageenan-locust bean gum gel beads, gellan-xanthan beads, poly(lactide-co-glycolides), carrageenan, starch poly-anhydrides, starch polymethacrylates, polyamino acids, and enteric coating polymers.

In some embodiments, the genetically engineered bacteria are enterically coated for release into the gut or a particular region of the gut, for example, the small or large intestines. The typical pH profile from the stomach to the colon is about 1-4 (stomach), 5.5-6 (duodenum), 7.3-8.0 (ileum), and 5.5-6.5 (colon). In some diseases, the pH profile may be modified. In some embodiments, the coating is degraded in specific pH environments in order to specify the site of release. In some embodiments, at least two coatings are used. In some embodiments, the outside coating and the inside coating are degraded at different pH levels.

In some embodiments, enteric coating materials may be used, in one or more coating layers (e.g., outer, inner and/o intermediate coating layers). Enteric coated polymers remain unionised at low pH, and therefore remain insoluble. But as the pH increases in the gastrointestinal tract, the acidic functional groups are capable of ionisation, and the polymer swells or becomes soluble in the intestinal fluid.

Materials used for enteric coatings include Cellulose acetate phthalate (CAP), Poly(methacrylic acid-co-methyl methacrylate), Cellulose acetate trimellitate (CAT), Poly (vinyl acetate phthalate) (PVAP) and Hydroxypropyl methylcellulose phthalate (HPMCP), fatty acids, waxes, Shellac (esters of aleurtic acid), plastics and plant fibers. Additionally, Zein, Aqua-Zein (an aqueous zein formulation containing no alcohol), amylose starch and starch derivatives, and dextrins (e.g., maltodextrin) are also used. Other known enteric coatings include ethylcellulose, methylcellulose, hydroxypropyl methylcellulose, amylose acetate phthalate, cellulose acetate phthalate, hydroxyl propyl methyl cellulose phthalate, an ethylacrylate, and a methylmethacrylate.

Coating polymers also may comprise one or more of, phthalate derivatives, CAT, HPMCAS, polyacrylic acid derivatives, copolymers comprising acrylic acid and at least one acrylic acid ester, Eudragit™ S (poly(methacrylic acid, methyl methacrylate)1:2); Eudragit L100™ S (poly(methacrylic acid, methyl methacrylate) 1:1); Eudragit L30D™, (poly(methacrylic acid, ethyl acrylate)1:1); and (Eudragit L100-55) (poly(methacrylic acid, ethyl acrylate)1:1) (Eudragit™ L is an anionic polymer synthesized from methacrylic acid and methacrylic acid methyl ester), polymethyl methacrylate blended with acrylic acid and acrylic ester copolymers, alginic acid, ammonia alginate, sodium, potassium, magnesium or calcium alginate, vinyl acetate copolymers, polyvinyl acetate 30D (30% dispersion in water), a neutral methacrylic ester comprising poly(dimethylaminoethylacrylate) ("Eudragit E™), a copolymer of methylmethacrylate and ethylacrylate with trimethylammonioethyl methacrylate chloride, a copolymer of methylmethacrylate and ethylacrylate, Zein, shellac, gums, or polysaccharides, or a combination thereof.

Coating layers may also include polymers which contain Hydroxypropylmethylcellulose (HPMC), Hydroxypropylethylcellulose (HPEC), Hydroxypropylcellulose (HPC), hydroxypropylethylcellulose (HPEC), hydroxymethylpropylcellulose (HMPC), ethylhydroxyethylcellulose (EHEC) (Ethulose), hydroxyethylmethylcellulose (HEMC), hydroxymethylethylcellulose (HMEC), propylhydroxyethylcellulose (PHEC), methylhydroxyethylcellulose (M H EC), hydrophobically modified hydroxyethylcellulose (NEXTON), carboxymethyl hydroxyethylcellulose (CMHEC), Methylcellulose, Ethylcellulose, water soluble vinyl acetate copolymers, gums, polysaccharides such as alginic acid and alginates such as ammonia alginate, sodium alginate, potassium alginate, acid phthalate of carbohydrates, amylose acetate phthalate, cellulose acetate phthalate (CAP), cellulose ester phthalates, cellulose ether phthalates, hydroxypropylcellulose phthalate (HPCP), hydroxypropylethylcellulose phthalate (HPECP), hydroxyproplymethylcellulose phthalate (HPMCP), hydroxyproplymethylcellulose acetate succinate (HPMCAS).

Liquid preparations for oral administration may take the form of solutions, syrups, suspensions, or a dry product for constitution with water or other suitable vehicle before use. Such liquid preparations may be prepared by conventional means with pharmaceutically acceptable agents such as suspending agents (e.g., sorbitol syrup, cellulose derivatives, or hydrogenated edible fats); emulsifying agents (e.g., lecithin or acacia); non-aqueous vehicles (e.g., almond oil, oily esters, ethyl alcohol, or fractionated vegetable oils); and preservatives (e.g., methyl or propyl-p-hydroxybenzoates or sorbic acid). The preparations may also contain buffer salts, flavoring, coloring, and sweetening agents as appropriate. Preparations for oral administration may be suitably formulated for slow release, controlled release, or sustained release of the genetically engineered bacteria of the invention.

In certain embodiments, the genetically engineered bacteria of the invention may be orally administered, for example, with an inert diluent or an assimilable edible carrier. The compound may also be enclosed in a hard or soft shell gelatin capsule, compressed into tablets, or incorporated directly into the subject's diet. For oral therapeutic administration, the compounds may be incorporated with excipients and used in the form of ingestible tablets, buccal tablets, troches, capsules, elixirs, suspensions, syrups, wafers, and the like. To administer a compound of the invention by other than parenteral administration, it may be necessary to coat the compound with, or co-administer the compound with, a material to prevent its inactivation.

In some embodiments, the composition is formulated for intraintestinal administration, intrajejunal administration, intraduodenal administration, intraileal administration, gastric shunt administration, or intracolic administration, via nanoparticles, nanocapsules, microcapsules, or microtablets, which are enterically coated or uncoated. The pharmaceutical compositions of the present invention may also be formulated in rectal compositions such as suppositories or retention enemas, using, e.g., conventional suppository bases such as cocoa butter or other glycerides. The compositions may be suspensions, solutions, or emulsions in oily or aqueous vehicles, and may contain suspending, stabilizing and/or dispersing agents.

The genetically engineered bacteria of the invention may be administered intranasally, formulated in an aerosol form, spray, mist, or in the form of drops, and conveniently delivered in the form of an aerosol spray presentation from pressurized packs or a nebuliser, with the use of a suitable propellant (e.g., dichlorodifluoromethane, trichlorofluoromethane, dichlorotetrafluoroethane, carbon dioxide or other suitable gas). Pressurized aerosol dosage units may be determined by providing a valve to deliver a metered amount. Capsules and cartridges (e.g., of gelatin) for use in an inhaler or insufflator may be formulated containing a powder mix of the compound and a suitable powder base such as lactose or starch.

The genetically engineered bacteria of the invention may be administered and formulated as depot preparations. Such long acting formulations may be administered by implantation or by injection. For example, the compositions may be formulated with suitable polymeric or hydrophobic materials (e.g., as an emulsion in an acceptable oil) or ion exchange resins, or as sparingly soluble derivatives (e.g., as a sparingly soluble salt).

In some embodiments, the invention provides pharmaceutically acceptable compositions in single dosage forms. Single dosage forms may be in a liquid or a solid form. Single dosage forms may be administered directly to a patient without modification or may be diluted or reconstituted prior to administration. In certain embodiments, a single dosage form may be administered in bolus form, e.g., single injection, single oral dose, including an oral dose that comprises multiple tablets, capsule, pills, etc. In alternate embodiments, a single dosage form may be administered over a period of time, e.g., by infusion.

Single dosage forms of the pharmaceutical composition of the invention may be prepared by portioning the pharmaceutical composition into smaller aliquots, single dose containers, single dose liquid forms, or single dose solid forms, such as tablets, granulates, nanoparticles, nanocapsules, microcapsules, microtablets, pellets, or powders, which may be enterically coated or uncoated. A single dose in a solid form may be reconstituted by adding liquid, typically sterile water or saline solution, prior to administration to a patient.

Dosage regimens may be adjusted to provide a therapeutic response. For example, a single bolus may be administered at one time, several divided doses may be administered over a predetermined period of time, or the dose may be reduced or increased as indicated by the therapeutic situation. The specification for the dosage is dictated by the unique characteristics of the active compound and the particular therapeutic effect to be achieved. Dosage values may vary with the type and severity of the condition to be alleviated. For any particular subject, specific dosage regimens may be adjusted over time according to the individual need and the professional judgment of the treating clinician.

In another embodiment, the composition can be delivered in a controlled release or sustained release system. In one embodiment, a pump may be used to achieve controlled or sustained release. In another embodiment, polymeric materials can be used to achieve controlled or sustained release of the therapies of the present disclosure (see e.g., U.S. Pat. No. 5,989,463). Examples of polymers used in sustained release formulations include, but are not limited to, poly(2-hydroxy ethyl methacrylate), poly(methyl methacrylate), poly(acrylic acid), poly(ethylene-co-vinyl acetate), poly(methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. The polymer used in a sustained release formulation may be inert, free of leachable impurities, stable on storage, sterile, and biodegradable. In some embodiments, a controlled or sustained release system can be placed in proximity of the prophylactic or therapeutic target, thus requiring only a fraction of the systemic dose. Any suitable technique known to one of skill in the art may be used.

The genetically engineered bacteria of the invention may be administered and formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

The ingredients are supplied either separately or mixed together in unit dosage form, for example, as a dry lyophilized powder or water-free concentrate in a hermetically sealed container such as an ampoule or sachet indicating the quantity of active agent. If the mode of administration is by injection, an ampoule of sterile water for injection or saline can be provided so that the ingredients may be mixed prior to administration.

The pharmaceutical compositions of the invention may be packaged in a hermetically sealed container such as an ampoule or sachet indicating the quantity of the agent. In one embodiment, one or more of the pharmaceutical compositions of the invention is supplied as a dry sterilized lyophilized powder or water-free concentrate in a hermetically sealed container and can be reconstituted (e.g., with water or saline) to the appropriate concentration for administration to a subject. In an embodiment, one or more of the prophylactic or therapeutic agents or pharmaceutical compositions of the invention is supplied as a dry sterile lyophilized powder in a hermetically sealed container stored between 2° C. and 8° C. and administered within 1 hour, within 3 hours, within 5 hours, within 6 hours, within 12 hours, within 24 hours, within 48 hours, within 72 hours, or within one week after being reconstituted. Cryoprotectants can be included for a lyophilized dosage form, principally 0-10% sucrose (optimally 0.5-1.0%). Other suitable cryoprotectants include trehalose and lactose. Other suitable bulking agents include glycine and arginine, either of which can be included at a concentration of 0-0.05%, and polysorbate-80 (optimally included at a concentration of 0.005-0.01%). Additional surfactants include but are not limited to polysorbate 20 and BRIJ surfactants. The pharmaceutical composition may be prepared as an injectable solution and can further comprise an agent useful as an adjuvant, such as those used to increase absorption or dispersion, e.g., hyaluronidase.

Dosing can depend on several factors, including severity and responsiveness of the disease, route of administration, time course of treatment (days to months to years), and time to amelioration of the disease. Toxicity and therapeutic efficacy of compounds provided herein can be determined by standard pharmaceutical procedures in cell culture or animal models. For example, $LD_{50}$, $ED_{50}$, $EC_{50}$, and $IC_{50}$ may be determined, and the dose ratio between toxic and therapeutic effects ($LD_{50}/ED_{50}$) may be calculated as the therapeutic index. Compositions that exhibit toxic side effects may be used, with careful modifications to minimize potential damage to reduce side effects. Dosing may be estimated initially from cell culture assays and animal models. The data obtained from in vitro and in vivo assays and animal studies can be used in formulating a range of dosage for use in humans.

Methods of Treatment

Another aspect of the invention provides methods of treating metabolic disease, e.g., obesity, type 2 diabetes. In some embodiments, the metabolic disease is selected from the group consisting of type 1 diabetes; type 2 diabetes; metabolic syndrome; Bardet-Biedel syndrome; Prader-Willi syndrome; non-alcoholic fatty liver disease; tuberous sclerosis; Albright hereditary osteodystrophy; brain-derived neurotrophic factor (BDNF) deficiency; Single-minded 1 (SIM1) deficiency; leptin deficiency; leptin receptor deficiency; pro-opiomelanocortin (POMC) defects; proprotein convertase subtilisin/kexin type 1 (PCSK1) deficiency; Src homology 2B1 (SH2B1) deficiency; pro-hormone convertase 1/3 deficiency; melanocortin-4-receptor (MC4R) deficiency; Wilms tumor, aniridia, genitourinary anomalies, and mental retardation (WAGR) syndrome; pseudohypoparathyroidism type 1A; Fragile X syndrome; Borjeson-Forsmann-Lehmann syndrome; Alstrom syndrome; Cohen syndrome; and ulnar-mammary syndrome. In some embodiments, the invention provides methods for reducing, ameliorating, or eliminating one or more symptom(s) associated with these diseases, including but not limited to weight gain, obesity, fatigue, hyperlipidemia, hyperphagia, hyperdipsia, polyphagia, polydipsia, polyuria, pain of the extremities, numbness of the extremities, blurry vision, nystagmus, hearing loss, cardiomyopathy, insulin resistance, light sensitivity, pulmonary disease, liver disease, liver cirrhosis, liver failure, kidney disease, kidney failure, seizures, hypogonadism, and infertility. In some embodiments, the subject to be treated is a human patient.

The method may comprise preparing a pharmaceutical composition with at least one genetically engineered species, strain, or subtype of bacteria described herein, and administering the pharmaceutical composition to a subject in a therapeutically effective amount. In some embodiments, the genetically engineered bacteria of the invention are administered orally, e.g., in a liquid suspension. In some embodiments, the genetically engineered bacteria of the invention are lyophilized in a gel cap and administered orally. In some embodiments, the genetically engineered bacteria of the invention are administered via a feeding tube or gastric shunt. In some embodiments, the genetically engineered bacteria of the invention are administered rectally, e.g., by enema. In some embodiments, the genetically engineered bacteria of the invention are administered topically, intraintestinally, intrajejunally, intraduodenally, intraileally, and/or intracolically.

In certain embodiments, the pharmaceutical composition described herein is administered to treat, manage, ameliorate, or prevent metabolic disease in a subject. In some embodiments, the method of treating or ameliorating metabolic disease allows one or more symptoms of the disease to improve by at least about 5%, 10%, 20%, 30%, 40%, 50%, 60%, 70%, 80%, 90%, 95%, or more as compared to levels in an untreated or control subject. In some embodiments, the symptom (e.g., obesity, insulin resistance) is measured by comparing measurements in a subject before and after administration of the pharmaceutical composition.

Before, during, and after the administration of the pharmaceutical composition in a subject, metabolic symptoms and manifestations may be measured in a biological sample, e.g., blood, serum, plasma, urine, fecal matter, peritoneal fluid, a sample collected from a tissue, such as liver, skeletal muscle, pancreas, epididymal fat, subcutaneous fat, and beige fat. The biological samples may be analyzed to measure symptoms and manifestations of metabolic disease. Useful measurements include measures of lean mass, fat mass, body weight, food intake, GLP-1 levels, endotoxin levels, insulin levels, lipid levels, HbA1c levels, short-chain fatty acid levels, triglyceride levels, and nonesterified fatty acid levels. Useful assays include, but are not limited to, insulin tolerance tests, glucose tolerance tests, pyruvate tolerance tests, assays for intestinal permeability, and assays for glycaemia upon multiple fasting and refeeding time points. In some embodiments, the methods may include administration of the compositions of the invention to reduce metabolic symptoms and manifestations to baseline levels, e.g., levels comparable to those of a healthy control, in a subject. In some embodiments, the methods may include administration of the compositions of the invention to reduce metabolic symptoms and manifestations to undetectable levels in a subject, or to less than about 1%, 2%, 5%, 10%, 20%, 25%, 30%, 40%, 50%, 60%, 70%, 75%, or 80% of the subject's levels prior to treatment.

Figure 17:
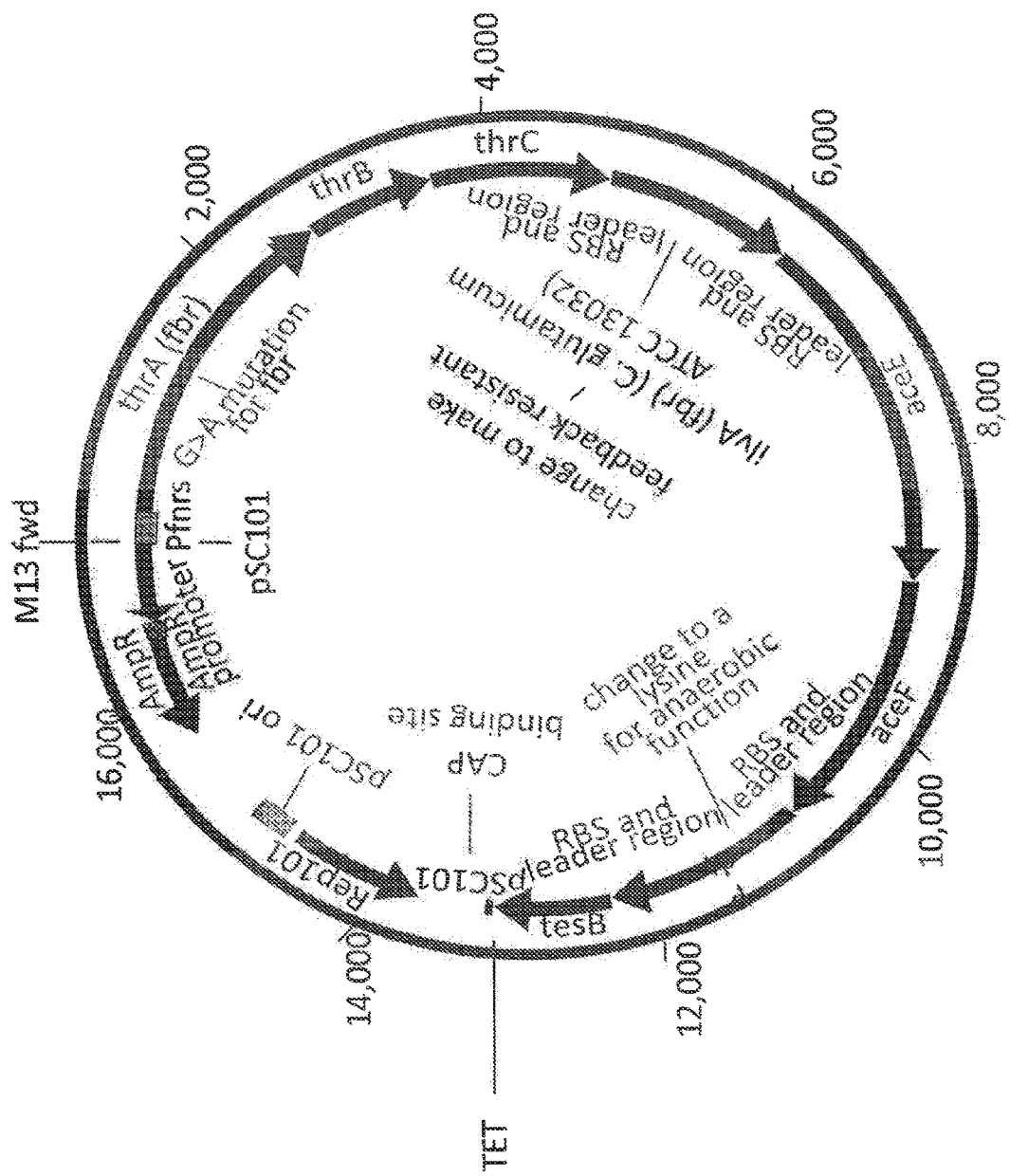
FIG. 17 depicts a schematic of an exemplary propionate biosynthesis gene cassette.
Figure 18:
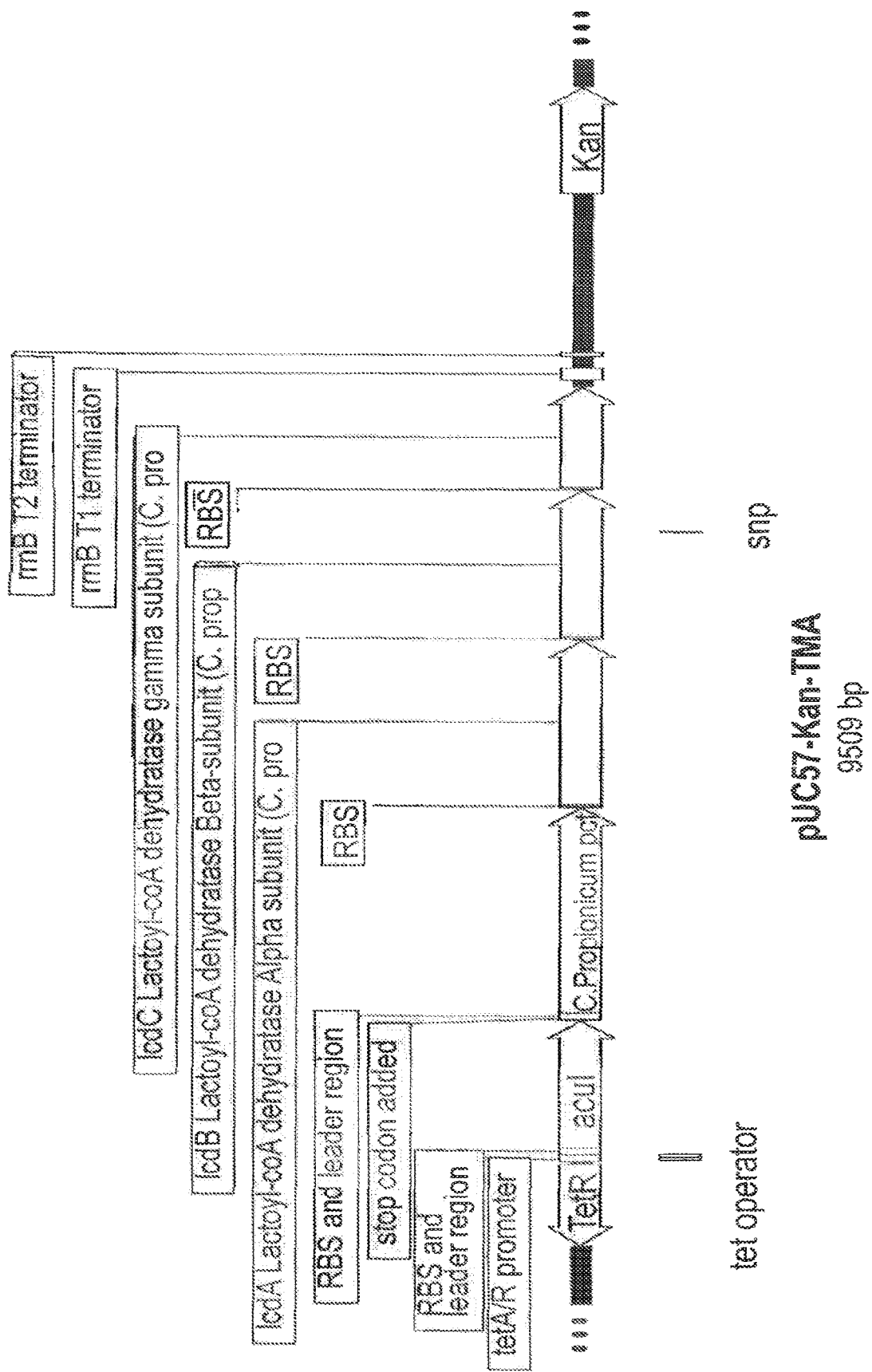
FIG. 18 depicts a schematic of an exemplary propionate biosynthesis gene cassette.
Figure 19:
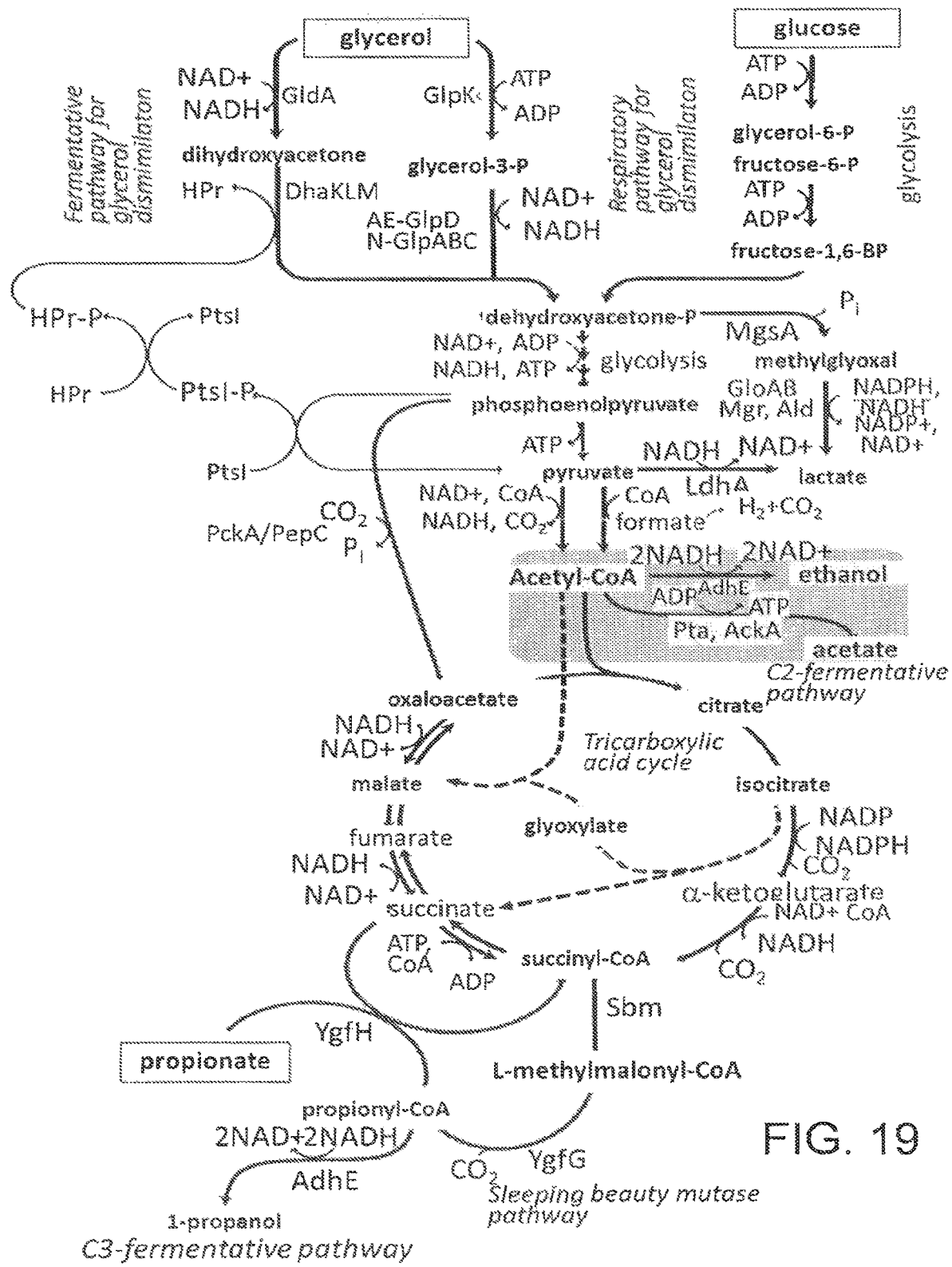
FIG. 19 depicts a schematic of a genetically engineered sleeping beauty metabolic pathway from *E. coli* for propionate production. Glucose and glycerol dissimilation pathways are shown under microaerobic conditions. In vivo, e.g., in a mammal, glycerol is not a substrate, and therefore only the glucose pathway is utilized.

In certain embodiments, the genetically engineered bacteria are *E. coli* Nissle. The genetically engineered bacteria may be destroyed, e.g., by defense factors in the gut or blood serum (Sonnenborn et al., 2009) or by activation of a kill switch, several hours or days after administration. Thus, the pharmaceutical composition comprising the genetically engineered bacteria may be re-administered at a therapeutically effective dose and frequency. Length of Nissle residence in vivo in mice is shown in FIG. 17. In alternate embodiments, the genetically engineered bacteria are not destroyed within hours or days after administration and may propagate and colonize the gut.

The pharmaceutical composition may be administered alone or in combination with one or more additional therapeutic agents, e.g., insulin. An important consideration in the selection of the one or more additional therapeutic agents is that the agent(s) should be compatible with the genetically engineered bacteria of the invention, e.g., the agent(s) must not kill the bacteria. The dosage of the pharmaceutical composition and the frequency of administration may be selected based on the severity of the symptoms and the progression of the disorder. The appropriate therapeutically effective dose and/or frequency of administration can be selected by a treating clinician.

Treatment In Vivo

The genetically engineered bacteria of the invention may be evaluated in vivo, e.g., in an animal model. Any suitable animal model of a metabolic disease may be used (see, e.g., Mizoguchi 2012). In some embodiments, the animal is a C57BL/6J mouse that is fed a high fat diet in order to induce obesity and T2DM-related symptoms such as hyperinsulinemia and hyperglycemia. In alternate embodiments, an animal harboring a genetic deficiency that causes a metabolic disease, e.g., a B6.BKS(D)-Lepr$^{db/db}$ mouse, is used.

The genetically engineered bacteria of the invention are administered to the mice before, during, or after the onset of obesity and disease. Body weight, food intake, and blood plasma (e.g., triglyceride levels, insulin tolerance tests, glucose tolerance tests, pyruvate tolerance tests) may be assayed to determine the severity and amelioration of disease. Metabolism and physical activity may be measured in metabolic cages. Animals may be sacrificed to assay metabolic tissues such as liver, skeletal muscle, epididymal fat, subcutaneous fat, brown fat, pancreas, and brain, are collected for analysis of histology and gene expression.

TABLE 29

Summary of rodent models of type 2 diabetes

| Induction mechanism | Model | Main features | Possible uses |
|---|---|---|---|
| Obese models (monogenic) | Lep$^{ob/ob}$ mice | Obesity-induced hyperglycaemia | Treatments to improve insulin resistance |
| | Lepr$^{db/db}$ mice | | Treatments to improve beta cell function |
| | ZDF Rats | | |
| Obese models (polygenic) | KK mice | Obesity-induced hyperglycaemia | Treatments to improve insulin resistance |
| | OLETF rat | | Treatments to improve beta cell function |
| | NZO mice | | Some models show diabetic complications |
| | TallyHo/Jng mice | | |
| | NoncNZO10/LtJ mice | | |
| Induced obesity | High fat feeding (mice or rats) | Obesity-induced hyperglycaemia | Treatments to improve insulin resistance |
| | Desert gerbil | | Treatments to improve beta cell function |
| | Nile grass rat | | Treatments to prevent diet-induced obesity |
| Non-obese models | GK rat | Hyperglycaemia induced by insufficient beta cell function/mass | Treatments to improve beta cell function |
| | | | Treatments to improve beta cell survival |
| Genetically induced models of beta cell dysfunction | hIAPP mice | Amyloid deposition in islets | Treatments to prevent amyloid deposition |
| | | | Treatments to improve beta cell survival |
| | AKITA mice | Beta cell destruction due to ER stress. | Treatments to prevent ER stress |
| | | | Treatments to improve beta cell survival |

As described in Aileen J F King, The use of animal models in diabetes research, Br J Pharmacol. 2012 June; 166(3): 877-894.

The engineered bacteria may be evaluated in vivo, e.g., in an animal model for NASH. Any suitable animal model of a disease associated with Non-Alcoholic Fatty Liver Disease/Non-Alcoholic Steatohepatitis (NAFLD/NASH) may be used. For example, the effects of liver steatosis and hepatic inflammation in an in vivo mouse model have been described (Jun Jin, et al., Brit. J. Nutrition, 114:145-1755 (2015)). To briefly summarize, female C57BL/6J mice can be fasted and fed either a standard liquid diet of carbohydrates, fat, and protein; or a liquid Western style diet (WSD) fortified with fructose, fat, cholesterol, and a sodium butyrate supplement for six weeks. Butyrate is a short chain fatty acid naturally produced by intestinal bacteria effective in maintaining intestinal homoeostasis. Body weight and plasma samples can be taken throughout the duration of the study. Upon conclusion of the study, the mice can be killed, and the liver and intestine can be removed and assayed.

An in vivo rat model of choline deficient/L-amino acid defined (CDAA) diet has also been described (Endo, et al., PLoS One, 8(5):e63388 (2013)). In this model, rats are fed the CDAA diet for eight weeks and then treated with a strain of *Clostridium butyricum* (MIYAIRI 588) two weeks after. The diet induces NAFLD/NASH symptoms such as liver steatosis, steatohepatitis, fibrosis, cirrhosis, and hepatocarcinogenesis. The rats are killed at 8, 16, and 50 weeks after completion of the diet regiments, and liver tissues removed and assayed.

Other models are known in the art, including a Lepob/Lepob and C57BL6 (B6) mouse model used to study the effects of high fat diet and GLP-1 administration within the NASH setting. See, for example, Trevaskis et al., Am. J. Physiology-Gastrointestinal and Liver Physiology, 302(8): G762-G772, 2012, and Takahashi et al., World J. Gastroenterol., 18(19):2300-2308, 2012, the entire contents of each of which are expressly incorporated herein by reference.

REFERENCES

Aboulnaga et al. Effect of an oxygen-tolerant bifurcating butyryl coenzyme A dehydrogenase/electron-transferring flavoprotein complex from *Clostridium difficile* on butyrate production in *Escherichia coli*. J Bact. 2013; 195(16):3704-3713.

Altenhoefer et al. The probiotic *Escherichia coli* strain Nissle 1917 interferes with invasion of human intestinal epithelial cells by different enteroinvasive bacterial pathogens. FEMS Immunol Med Microbiol. 2004 Apr. 9; 40(3):223-9. PMID: 15039098.

Arai et al. Expression of the nir and nor genes for denitrification of *Pseudomonas aeruginosa* requires a novel CRP/FNR-related transcriptional regulator, DNR, in addition to ANR. FEBS Lett. 1995 Aug. 28; 371(1):73-6. PMID: 7664887.

Brüssow et al. You are what you eat. Nat Biotechnol. 2014 March; 32(3):243-5. PMID: 24727777.

Callura et al. Tracking, Tuning and terminating microbial physiology using synthetic riboregulators. Proc Natl Acad Sci. 2010; 27(36):15898-15903.

Castiglione et al. The transcription factor DNR from *Pseudomonas aeruginosa* specifically requires nitric oxide and haem for the activation of a target promoter in *Escherichia coli*. Microbiology. 2009 September; 155(Pt 9):2838-44. PubMed PMID: 19477902.

Chen et al. Incorporation of therapeutically modified bacteria into gut microbiota inhibits obesity. J Clin Invest. 2014 August; 124(8):3391-406. PMID: 24960158.

Clarkson et al. Diaminopimelic acid and lysine auxotrophs of *Pseudomonas aeruginosa* 8602. J Gen Microbiol. 1971 May; 66(2):161-9. PubMed PMID: 4999073.

De Vadder et al. Microbiota-generated metabolites promote metabolic benefits via gut-brain neural circuits. Cell. 2014 Jan. 16; 156(1-2):84-96. PMID: 24412651.

Dinleyici et al. *Saccharomyces boulardii* CNCM I-745 in different clinical conditions. Expert Opin Biol Ther. 2014 November; 14(11):1593-609. PubMed PMID: 24995675.

Eiglmeier et al. Molecular genetic analysis of FNR-dependent promoters. Mol Microbiol. 1989 July; 3(7):869-78. PubMed PMID: 2677602.

Frenzel et al. Expression of recombinant antibodies. Front Immunol. 2013; 4:217. PMID: 23908655.

Galimand et al. Positive FNR-like control of anaerobic arginine degradation and nitrate respiration in *Pseudomonas aeruginosa*. J Bacteriol. 1991 March; 173(5):1598-606. PubMed PMID: 1900277; PubMed Central PMCID: PMC207308.

Gallwitz et al. GLP-1-analogues resistant to degradation by dipeptidyl-peptidase IV in vitro. Regul Pept. 2000 Jan. 29; 86(1-3):103-11. PubMed PMID: 10672909.

Gardner et al. Construction of a genetic toggle switch in *Escherichia coli*. Nature 2000; 403:339-342.

Harley et al. Obesity and the gut microbiome: Striving for causality. Mol Metab. 2012 Aug. 3; 1(1-2):21-31. PMID: 24024115.

Hasegawa et al. Activation of a consensus FNR-dependent promoter by DNR of *Pseudomonas aeruginosa* in response to nitrite. FEMS Microbiol Lett. 1998 Sep. 15; 166(2):213-7. PubMed PMID: 9770276.

Hetzel et al. Acryloyl-CoA reductase from *Clostridium propionicum*. An enzyme complex of propionyl-CoA dehydrogenase and electron-transferring flavoprotein. Eur J Biochem. 2003

Hillman R E. Simple, rapid method for determination of propionic acid and other short-chain fatty acids in serum. Clin Chem. 1978 May; 24(5):800-3. PubMed PMID: 647915.

Hoeren et al. Sequence and expression of the gene encoding the respiratory nitrous-oxide reductase from *Paracoccus denitrificans*. New and conserved structural and regulatory motifs. Eur J Biochem. 1993 Nov. 15; 218(1):49-57. PubMed PMID: 8243476.

March; 270(5):902-10. PubMed PMID: 12603323. Hristodorov et al. Recombinant H22(scFv) blocks CD64 and prevents the capture of anti-TNF monoclonal antibody. A potential strategy to enhance anti-TNF therapy. MAbs. 2014; 6(5):1283-9. PMID: 25517313.

Isabella et al. Deep sequencing-based analysis of the anaerobic stimulon in *Neisseria gonorrhoeae*. BMC Genomics. 2011 Jan. 20; 12:51. PubMed PMID: 21251255.

Karagiannis et al. Safety of dipeptidyl peptidase 4 inhibitors: a perspective review. Ther Adv Drug Saf. 2014 June; 5(3):138-46. PMID: 25083269.

Keates et al. TransKingdom RNA interference: a bacterial approach to challenges in RNAi therapy and delivery. Biotechnol Genet Eng Rev. 2008; 25:113-27. PubMed PMID: 21412352.

Kleman et al. Acetate metabolism by *Escherichia coli* in high-cell-density fermentation. Appl Environ Microbiol. 1994 November; 60(11):3952-8. PMID: 7993084.

Lin et al. Butyrate and propionate protect against diet-induced obesity and regulate gut hormones via free fatty acid receptor 3-independent mechanisms. PLoS One. 2012; 7(4):e35240. PubMed PMID: 22506074; PubMed Central PMCID: PMC3323649.

Lukovac et al. Differential modulation by *Akkermansia muciniphila* and *Faecalibacterium prausnitzii* of host peripheral lipid metabolism and histone acetylation in mouse gut organoids. MBio. 2014 Aug. 12; 5(4). pii: e01438-14. PubMed PMID: 25118238.

Mathur et al. Obesity and the microbiome. Expert Rev Gastroenterol Hepatol. 2015 Jun 16:1-13. PubMed PMID: 26082274.

Meadow et al. Biosynthesis of diaminopimelic acid and lysine in *Escherichia coli*. Biochem J. 1959 July; 72(3): 396-400. PubMed PMID: 16748796.

Mizoguchi. Animal models of inflammatory bowel disease. Prog Mol Biol Transl Sci. 2012; 105:263-320. PubMed PMID: 22137435.

Moore et al. Regulation of FNR dimerization by subunit charge repulsion. J Biol Chem. 2006 Nov. 3; 281(44): 33268-75. PubMed PMID: 16959764.

Musso et al. Gut microbiota as a regulator of energy homeostasis and ectopic fat deposition: mechanisms and implications for metabolic disorders. Curr Opin Lipidol. 2010 February; 21(1):76-83. Review. PubMed PMID: 19915460.

Nissen et al. Effect of rosiglitazone on the risk of myocardial infarction and death from cardiovascular causes. N Engl J Med. 2007 Jun. 14; 356(24):2457-71. PMID: 17517853.

Purcell et al. Towards a whole-cell modeling approach for synthetic biology. Chaos. 2013 June; 23(2):025112. PMID: 23822510.

Ragsdale. Enzymology of the wood-Ljungdahl pathway of acetogenesis. Ann N Y Acad Sci. 2008 March; 1125:129-36. PMID: 18378591.

Ray et al. The effects of mutation of the anr gene on the aerobic respiratory chain of *Pseudomonas aeruginosa*. FEMS Microbiol Lett. 1997 Nov. 15; 156(2):227-32. PubMed PMID: 9513270.

Reister et al. Complete genome sequence of the Gram-negative probiotic *Escherichia coli* strain Nissle 1917. J Biotechnol. 2014 Oct. 10; 187:106-7. PubMed PMID: 25093936.

Rembacken et al. Non-pathogenic *Escherichia coli* versus mesalazine for the treatment of ulcerative colitis: a randomised trial. Lancet. 1999 Aug. 21; 354(9179):635-9. PubMed PMID: 10466665.

Remington's Pharmaceutical Sciences, 22$^{nd}$ ed. Mack Publishing Co.

Sat et al. The *Escherichia coli* mazEF suicide module mediates thymineless death. J Bacteriol. 2003 March; 185(6):1803-7. PubMed PMID: 12618443.

Sawers. Identification and molecular characterization of a transcriptional regulator from *Pseudomonas aeruginosa* PAO1 exhibiting structural and functional similarity to the FNR protein of *Escherichia coli*. Mol Microbiol. 1991 June; 5(6):1469-81. PubMed PMID: 1787797.

Schiel-Bengelsdorf et al. Pathway engineering and synthetic biology using acetogens. FEBS Lett. 2012 Jul. 16; 586 (15):2191-8. PMID: 22710156.

Schultz. Clinical use of *E. coli* Nissle 1917 in inflammatory bowel disease. Inflamm Bowel Dis. 2008 July; 14(7): 1012-8. Review. PubMed PMID: 18240278.

Selmer et al. Propionate CoA-transferase from *Clostridium propionicum*. Cloning of gene and identification of glutamate 324 at the active site. Eur J Biochem. 2002 January; 269(1):372-80. PubMed PMID: 11784332.

Sonnenborn et al. The non-pathogenic *Escherichia coli* strain Nissle 1917—features of a versatile probiotic. Microbial Ecology in Health and Disease. 2009; 21:122-158.

Térová et al. N-acyl phosphatidylethanolamines affect the lateral distribution of cholesterol in membranes. Biochim Biophys Acta. 2005 Aug. 30; 1715(1):49-56. PMID: 16087152.

Trunk et al. Anaerobic adaptation in *Pseudomonas aeruginosa*: definition of the Anr and Dnr regulons. Environ Microbiol. 2010 June; 12(6):1719-33. PMID: 20553552.

Tseng et al. Controlled biosynthesis of odd-chain fuels and chemicals via engineered modular metabolic pathways. Proc Natl Acad Sci USA. 2012 Oct. 30; 109(44):17925-30. PubMed PMID:23071297; PubMed Central PMCID: PMC3497732.

Ukena et al. Probiotic *Escherichia coli* Nissle 1917 inhibits leaky gut by enhancing mucosal integrity. PLoS One. 2007 Dec. 12; 2(12):e1308. PMID: 18074031.

Unden et al. Alternative respiratory pathways of *Escherichia coli*: energetics and transcriptional regulation in response to electron acceptors. Biochim Biophys Acta. 1997 Jul. 4; 1320(3):217-34. PMID: 9230919.

Winteler et al. The homologous regulators ANR of *Pseudomonas aeruginosa* and FNR of *Escherichia coli* have overlapping but distinct specificities for anaerobically inducible promoters. Microbiology. 1996 March; 142 (Pt 3):685-93. PubMed PMID: 8868444.

Xiao et al. Nanoparticles with surface antibody against CD98 and carrying CD98 small interfering RNA reduce colitis in mice. Gastroenterology. 2014 May; 146(5): 1289-300. PMID: 24503126.

Yazbeck et al. Growth factor based therapies and intestinal disease: is glucagon-like peptide-2 the new way forward? Cytokine Growth Factor Rev. 2009 April; 20(2):175-84. PMID: 19324585.

Zimmermann et al. Anaerobic growth and cyanide synthesis of *Pseudomonas aeruginosa* depend on anr, a regulatory gene homologous with fnr of *Escherichia coli*. Mol Microbiol. 1991 June; 5(6):1483-90. PubMed PMID: 1787798.

EXAMPLES

The following examples provide illustrative embodiments of the disclosure. One of ordinary skill in the art will recognize the numerous modifications and variations that may be performed without altering the spirit or scope of the disclosure. Such modifications and variations are encompassed within the scope of the disclosure. The Examples do not in any way limit the disclosure.

Example 1. Construction of Vectors for Producing Propionate

To facilitate inducible production of propionate in *Escherichia coli* Nissle, a propionate gene cassette comprising the genes encoding the enzymes of the acrylate pathway, i.e., pct, lcdA, lcdB, lcdC, etfA, acrB, and acrC, as well as transcriptional and translational elements, are synthesized (Gen9, Cambridge, Mass.) and cloned into vector pBR322. The genes are codon-optimized for *E. coli* codon usage using Integrated DNA Technologies online codon optimization tool (https://www.idtdna.com/CodonOpt). A second clone is generated as described above using a propionate gene cassette comprising the genes encoding the enzymes of the pyruvate pathway, i.e., thrA$^{fbr}$, thrB, thrC, ilvA$^{fbr}$, aceE, aceF, and lpd; NCBI; Tseng et al., 2012). A third clone is generated as described above that comprises thrA$^{fbr}$, thrB, thrC, ilvA$^{fbr}$, aceE, aceF, lpd, and *E. coli* tesB. Each propionate gene cassette is expressed under the control of each of the following regulatory regions: a FNR-inducible regulatory region selected from the sequences listed in Table 21, a tetracycline-inducible promoter, and an arabinose-inducible promoter. In certain constructs, the FNR-responsive promoter is further fused to a strong ribosome binding site sequence. For efficient translation of propionate genes, each synthetic gene in the operon was separated by a 15 base pair ribosome binding site derived from the T7 promoter/translational start site. Each gene cassette and regulatory region construct is expressed on a high-copy plasmid, a low-copy plasmid, or a chromosome.

The propionate construct is inserted into the bacterial genome at one or more of the following insertion sites in *E. coli* Nissle: malE/K, araC/BAD, lacZ, thyA, malP/T. Any suitable insertion site may be used (see, e.g., FIG. 47). The insertion site may be anywhere in the genome, e.g., in a gene required for survival and/or growth, such as thyA (to create an auxotroph); in an active area of the genome, such as near the site of genome replication; and/or in between divergent promoters in order to reduce the risk of unintended transcription, such as between AraB and AraC of the arabinose operon. At the site of insertion, DNA primers that are homologous to the site of insertion and to the propionate construct are designed. A linear DNA fragment containing the construct with homology to the target site is generated by PCR, and lambda red recombination is performed as described below. The resulting *E. coli* Nissle bacteria are genetically engineered to express a propionate biosynthesis cassette and produce propionate.

Example 2. Lambda Red Recombination

Lambda red recombination is used to make chromosomal modifications, e.g., to express a propionate biosynthesis cassette in *E. coli* Nissle. Lambda red is a procedure using recombination enzymes from a bacteriophage lambda to insert a piece of custom DNA into the chromosome of *E. coli*. A pKD46 plasmid is transformed into the *E. coli* Nissle host strain. *E. coli* Nissle cells are grown overnight in LB media. The overnight culture is diluted 1:100 in 5 mL of LB media and grown until it reaches an OD$_{600}$ of 0.4-0.6. All tubes, solutions, and cuvettes are pre-chilled to 4° C. The *E. coli* cells are centrifuged at 2,000 rpm for 5 min. at 4° C., the supernatant is removed, and the cells are resuspended in 1 mL of 4° C. water. The *E. coli* are centrifuged at 2,000 rpm for 5 min. at 4° C., the supernatant is removed, and the cells are resuspended in 0.5 mL of 4° C. water. The *E. coli* are centrifuged at 2,000 rpm for 5 min. at 4° C., the supernatant is removed, and the cells are resuspended in 0.1 mL of 4° C. water. The electroporator is set to 2.5 kV. 1 ng of pKD46 plasmid DNA is added to the *E. coli* cells, mixed by pipetting, and pipetted into a sterile, chilled cuvette. The dry cuvette is placed into the sample chamber, and the electric pulse is applied. 1 mL of room-temperature SOC media is immediately added, and the mixture is transferred to a culture tube and incubated at 30° C. for 1 hr. The cells are spread out on a selective media plate and incubated overnight at 30° C.

Figure 47:
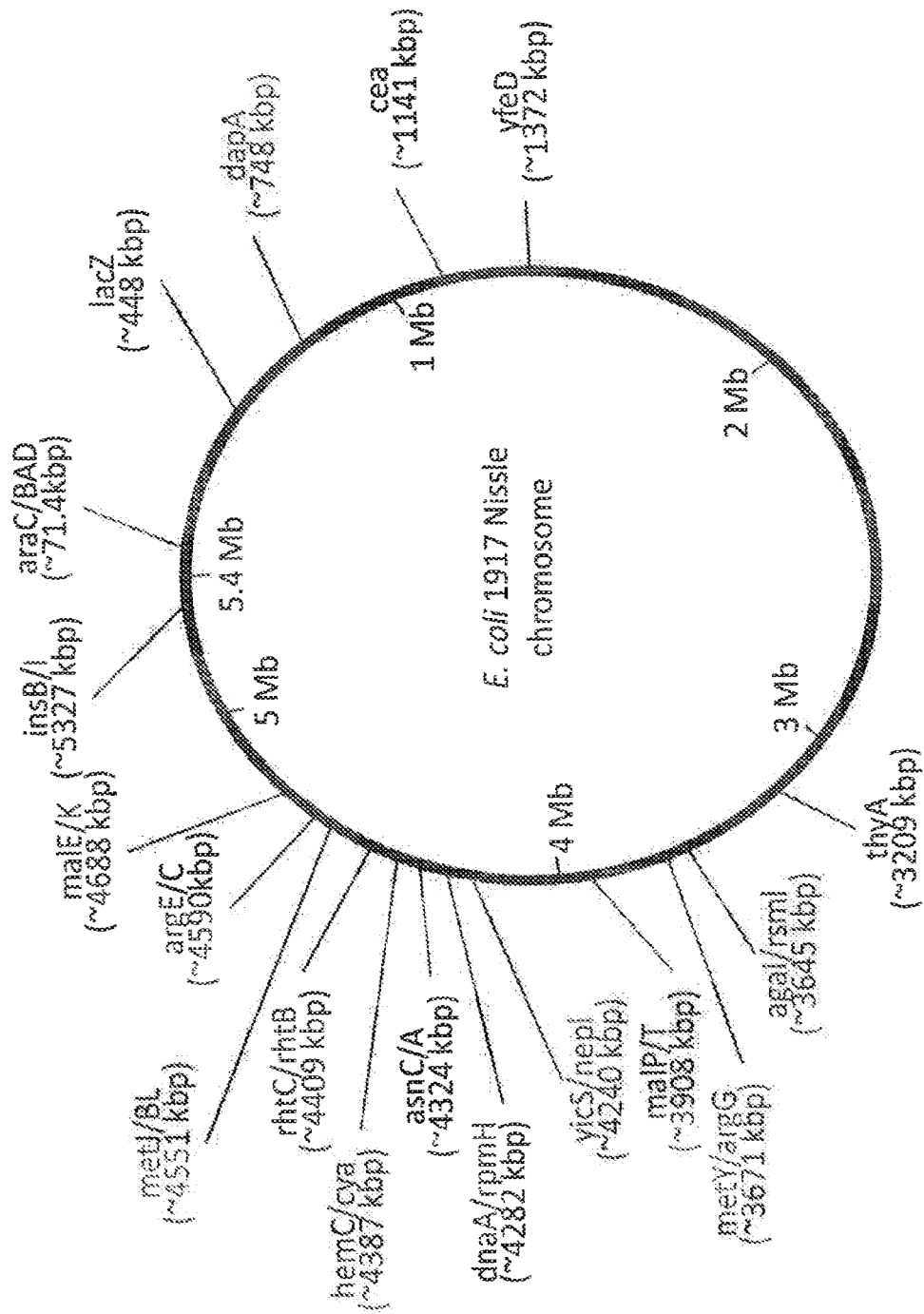
FIG. 47 depicts a map of exemplary integration sites within the *E. coli* 1917 Nissle chromosome. These sites indicate regions where circuit components may be inserted into the chromosome without interfering with essential gene expression. Backslashes (/) are used to show that the insertion will occur between divergently or convergently expressed genes. Insertions within biosynthetic genes, such as thyA, can be useful for creating nutrient auxotrophies. In some embodiments, an individual circuit component is inserted into more than one of the indicated sites. The malE/K site is circled. In some embodiments of the disclosure, FNR-ArgAfbr is inserted at the malEK locus.
Figure 48:
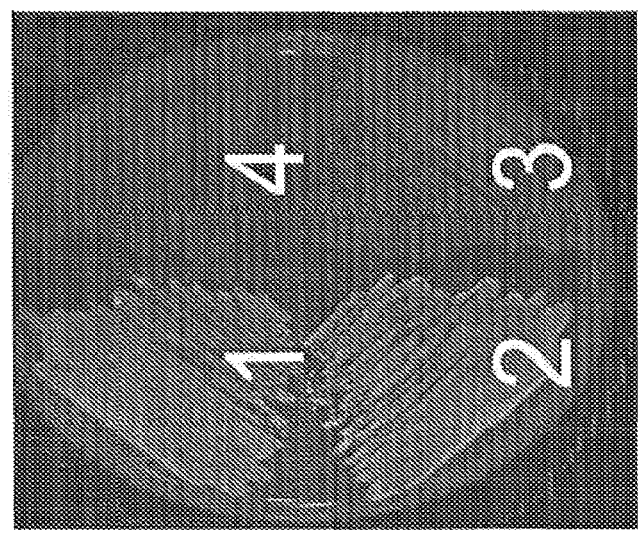
FIG. 48 depicts three bacterial strains which constitutively express red fluorescent protein (RFP). In strains 1-3, the rfp gene has been inserted into different sites within the bacterial chromosome, and results in varying degrees of brightness under fluorescent light. Unmodified *E. coli* Nissle (strain 4) is non-fluorescent.
Figure 49:
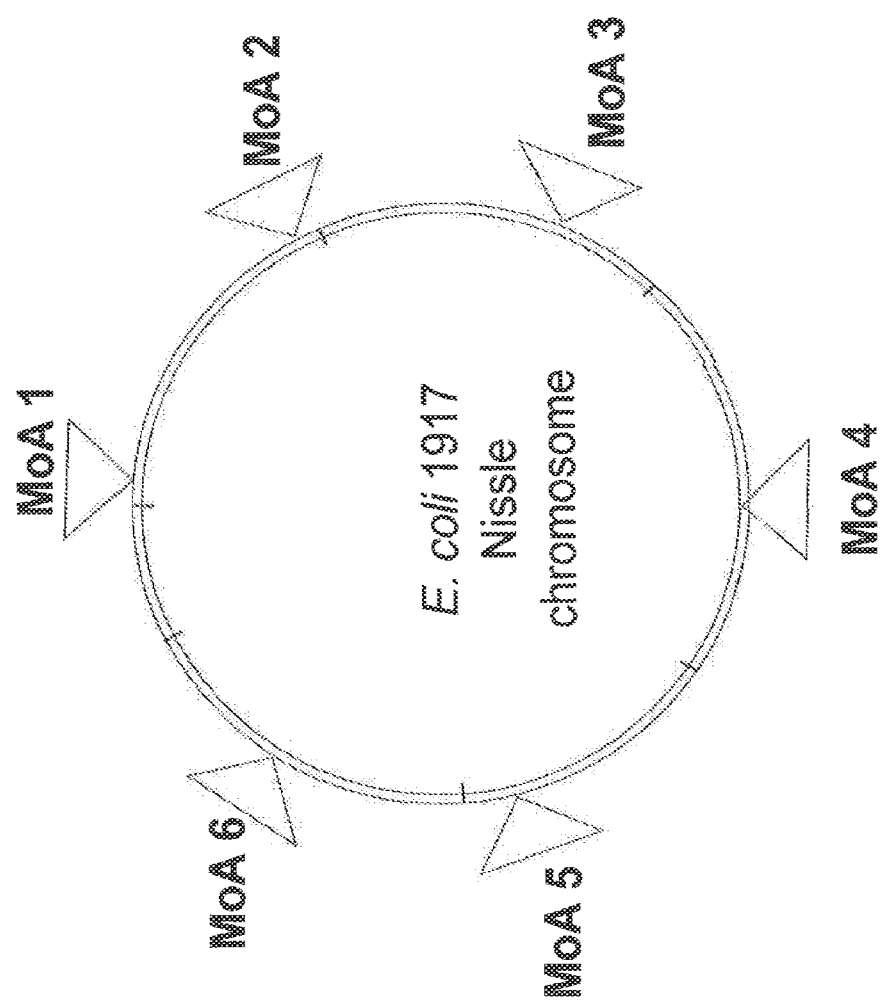
FIG. 49 depicts an exemplary schematic of the *E. coli* 1917 Nissle chromosome comprising multiple mechanisms of action (MoAs).
Figure 50:
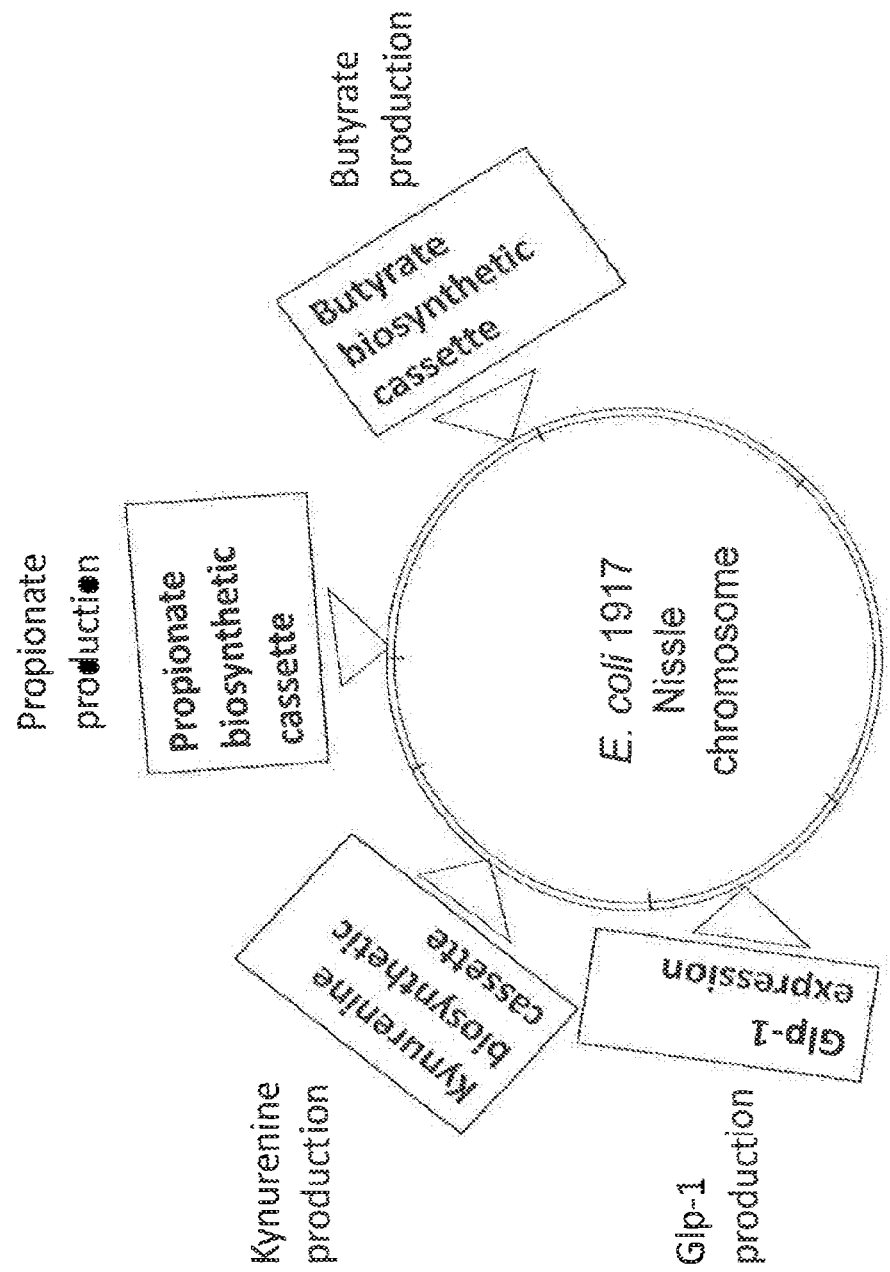
FIG. 50 depicts an exemplary schematic of the *E. coli* 1917 Nissle chromosome comprising multiple MoAs. In some embodiments, an Glp-1 expression circuit, a butyrate production circuit, a propionate production circuit, and a kynurenine biosynthetic cassette are inserted at four or more different chromosomal insertion sites

DNA sequences comprising the desired propionate biosynthesis genes shown above were ordered from a gene synthesis company. The lambda enzymes are used to insert this construct into the genome of *E. coli* Nissle through homologous recombination. The construct is inserted into a specific site in the genome of *E. coli* Nissle based on its DNA sequence. In some embodiments, the construct is in the *E. coli* Nissle genome at the malP/T site (FIG. 47). To insert the construct into a specific site, the homologous DNA sequence flanking the construct is identified, and includes approximately 50 bases on either side of the sequence. The homologous sequences are ordered as part of the synthesized gene. Alternatively, the homologous sequences may be added by PCR. The construct includes an antibiotic resistance marker that may be removed by recombination. The resulting construct comprises approximately 50 bases of homology upstream, a kanamycin resistance marker that can be removed by recombination, the propionate biosynthesis genes, and approximately 50 bases of homology downstream.

Example 3. Transforming *E. coli*

Each of the constructs above is transformed into *E. coli* Nissle comprising pKD46. All tubes, solutions, and cuvettes are pre-chilled to 4° C. An overnight culture is diluted 1:100 in 5 mL of LB media containing ampicillin and grown until it reaches an $OD_{600}$ of 0.1. 0.05 mL of 100× L-arabinose stock solution is added to induce pKD46 lambda red expression. The culture is grown until it reaches an $OD_{600}$ of 0.4-0.6. The *E. coli* cells are centrifuged at 2,000 rpm for 5 min. at 4° C., the supernatant is removed, and the cells are resuspended in 1 mL of 4° C. water. The *E. coli* are centrifuged at 2,000 rpm for 5 min. at 4° C., the supernatant is removed, and the cells are resuspended in 0.5 mL of 4° C. water. The *E. coli* are centrifuged at 2,000 rpm for 5 min. at 4° C., the supernatant is removed, and the cells are resuspended in 0.1 mL of 4° C. water. The electroporator is set to 2.5 kV. 0.5 µg of the construct is added to the cells, mixed by pipetting, and pipetted into a sterile, chilled cuvette. The dry cuvette is placed into the sample chamber, and the electric pulse is applied. 1 mL of room-temperature SOC media is immediately added, and the mixture is transferred to a culture tube and incubated at 37° C. for 1 hr. The cells are spread out on an LB plate containing kanamycin and incubated overnight.

In alternate embodiments, the propionate cassette may be inserted into the Nissle genome through homologous recombination (Geneweiz, Cambridge, Mass.). Organization of the constructs and nucleotide sequences are shown in FIGS. 1-5. To create a vector capable of integrating the synthesized propionate cassette construct into the chromosome, Gibson assembly was first used to add 1000 bp sequences of DNA homologous to the Nissle lacZ locus into the R6K origin plasmid pKD3. This targets DNA cloned between these homology arms to be integrated into the lacZ locus in the Nissle genome. Gibson assembly was used to clone the fragment between these arms. PCR was used to amplify the region from this plasmid containing the entire sequence of the homology arms, as well as the propionate cassette between them. This PCR fragment was used to transform electrocompetent Nissle-pKD46, a strain that contains a temperature-sensitive plasmid encoding the lambda red recombinase genes. After transformation, cells were grown out for 2 hours before plating on chloramphenicol at 20 ug/mL at 37 degrees C. Growth at 37 degrees C. also cures the pKD46 plasmid. Transformants containing cassette were chloramphenicol resistant and lac-minus (lac-).

Example 4. Verifying Mutants

The presence of the propionate gene cassette is verified by colony PCR. Colonies are picked with a pipette tip and resuspended in 20 µl of cold ddH$_2$O by pipetting up and down. 3 µl of the suspension is pipetted onto an index plate with appropriate antibiotic for use later. The index plate is grown at 37° C. overnight. A PCR master mix is made using 5 µl of 10×PCR buffer, 0.6 µl of 10 mM dNTPs, 0.4 µl of 50 mM Mg$_2$SO$_4$, 6.0 µl of 10× enhancer, and 3.0 µl of ddH$_2$O (15 µl of master mix per PCR reaction). A 10 µM primer mix is made by mixing 2 µL of primers unique to the propionate construct (100 µM stock) into 16 µL of ddH$_2$O. For each 20 µl reaction, 15 µL of the PCR master mix, 2.0 µL of the colony suspension (template), 2.0 µL of the primer mix, and 1.0 µL of Pfx Platinum DNA Pol are mixed in a PCR tube. The PCR thermocycler is programmed as follows, with steps 2-4 repeating 34 times: 1) 94° C. at 5:00 min., 2) 94° C. at 0:15 min., 3) 55° C. at 0:30 min., 4) 68° C. at 2:00 min., 5) 68° C. at 7:00 min., and then cooled to 4° C. The PCR products are analyzed by gel electrophoresis using 10 µL of each amplicon and 2.5 µL 5× dye. The PCR product only forms if the heterologous sequence has been inserted.

Example 5. Generation of ΔThyA

An auxotrophic mutation causes bacteria to die in the absence of an exogenously added nutrient essential for survival or growth because they lack the gene(s) necessary to produce that essential nutrient. In order to generate genetically engineered bacteria with an auxotrophic modification, the thyA, a gene essential for oligonucleotide synthesis was deleted. Deletion of the thyA gene in *E. coli* Nissle yields a strain that cannot form a colony on LB plates unless they are supplemented with thymidine.

A thyA::cam PCR fragment was amplified using 3 rounds of PCR as follows. Sequences of the primers used at a 100 um concentration are found in Table 30.

TABLE 30

Primer Sequences

| Name | Sequence | Description | SEQ ID NO |
|---|---|---|---|
| SR36 | tagaactgatgcaaaaagtgctcgacgaaggcacacagaTGTGTAGG CTGGAGCTGCTTC | Round 1: binds on pKD3 | SEQ ID NO: 194 |
| SR38 | gtttcgtaattagatagccaccggcgctttaatgcccggaCATATGAAT ATCCTCCTTAG | Round 1: binds on pKD3 | SEQ ID NO: 195 |
| SR33 | caacacgtttcctgaggaaccatgaaacagtatttagaactgatgcaaaaag | Round 2: binds to round 1 PCR product | SEQ ID NO: 196 |
| SR34 | cgcacactggcgtcggctctggcaggatgtttcgtaattagatagc | Round 2: binds to round 1 PCR product | SEQ ID NO: 197 |
| SR43 | atatcgtcgcagcccacagcaacacgtttcctgagg | Round 3: binds to round 2 PCR product | SEQ ID NO: 198 |

TABLE 30-continued

Primer Sequences

| Name | Sequence | Description | SEQ ID NO |
|---|---|---|---|
| SR44 | aagaatttaacggagggcaaaaaaaaccgacgcacactggcgtcggc | Round 3: binds to round 2 PCR product | SEQ ID NO: 199 |

For the first PCR round, 4×50 ul PCR reactions containing 1 ng pKD3 as template, 25 ul 2× phusion, 0.2 ul primer SR36 and SR38, and either 0, 0.2, 0.4 or 0.6 ul DMSO were brought up to 50 ul volume with nuclease free water and amplified under the following cycle conditions:

step1: 98c for 30 s
step2: 98c for 10 s
step3: 55c for 15 s
step4: 72c for 20 s
repeat step 2-4 for 30 cycles
step5: 72c for 5 min Subsequently, 5 ul of each PCR reaction was run on an agarose gel to confirm PCR product of the appropriate size. The PCR product was purified from the remaining PCR reaction using a Zymoclean gel DNA recovery kit according to the manufacturer's instructions and eluted in 30 ul nuclease free water.

For the second round of PCR, 1 ul purified PCR product from round 1 was used as template, in 4×50 ul PCR reactions as described above except with 0.2 ul of primers SR33 and SR34. Cycle conditions were the same as noted above for the first PCR reaction. The PCR product run on an agarose gel to verify amplification, purified, and eluted in 30 ul as described above.

For the third round of PCR, 1 ul of purified PCR product from round 2 was used as template in 4×50 ul PCR reactions as described except with primer SR43 and SR44. Cycle conditions were the same as described for rounds 1 and 2. Amplification was verified, the PCR product purified, and eluted as described above. The concentration and purity was measured using a spectrophotometer. The resulting linear DNA fragment, which contains 92 bp homologous to upstream of thyA, the chloramphenicol cassette flanked by frt sites, and 98 bp homologous to downstream of the thyA gene, was transformed into a E. coli Nissle 1917 strain containing pKD46 grown for recombineering. Following electroporation, 1 ml SOC medium containing 3 mM thymidine was added, and cells were allowed to recover at 37 C for 2 h with shaking. Cells were then pelleted at 10,000×g for 1 minute, the supernatant was discarded, and the cell pellet was resuspended in 100 ul LB containing 3 mM thymidine and spread on LB agar plates containing 3 mM thy and 20 ug/ml chloramphenicol. Cells were incubated at 37 C overnight. Colonies that appeared on LB plates were restreaked. +cam 20 ug/ml + or – thy 3 mM. (thyA auxotrophs will only grow in media supplemented with thy 3 mM).

Next, the antibiotic resistance was removed with pCP20 transformation. pCP20 has the yeast Flp recombinase gene, FLP, chloramphenicol and ampicillin resistant genes, and temperature sensitive replication. Bacteria were grown in LB media containing the selecting antibiotic at 37° C. until OD600=0.4-0.6. 1 mL of cells were washed as follows: cells were pelleted at 16,000×g for 1 minute. The supernatant was discarded and the pellet was resuspended in 1 mL ice-cold 10% glycerol. This wash step was repeated 3× times. The final pellet was resuspended in 70 ul ice-cold 10% glycerol. Next, cells were electroporated with 1 ng pCP20 plasmid DNA, and 1 mL SOC supplemented with 3 mM thymidine was immediately added to the cuvette. Cells were resuspended and transferred to a culture tube and grown at 30° C. for 1 hours. Cells were then pelleted at 10,000×g for 1 minute, the supernatant was discarded, and the cell pellet was resuspended in 100 ul LB containing 3 mM thymidine and spread on LB agar plates containing 3 mM thy and 100 ug/ml carbenicillin and grown at 30° C. for 16-24 hours. Next, transformants were colony purified non-selectively (no antibiotics) at 42° C.

To test the colony-purified transformants, a colony was picked from the 42° C. plate with a pipette tip and resuspended in 10 µL LB. 3 µL of the cell suspension was pipetted onto a set of 3 plates: Cam, (37° C.; tests for the presence/absence of CamR gene in the genome of the host strain), Amp, (30° C., tests for the presence/absence of AmpR from the pCP20 plasmid) and LB only (desired cells that have lost the chloramphenicol cassette and the pCP20 plasmid), 37° C. Colonies were considered cured if there is no growth in neither the Cam or Amp plate, picked, and re-streaked on an LB plate to get single colonies, and grown overnight at 37° C.

Example 6. Production of Propionate in Genetically Engineered E. coli

Production of propionate is assessed in E. coli Nissle strains containing the propionate cassettes described above. All incubations are performed at 37° C. Cultures of E. coli strains DH5a and Nissle transformed with the propionate cassettes are grown overnight in LB and then diluted 1:200 into 4 mL of M9 minimal medium containing 0.5% glucose. The cells are grown with shaking (250 rpm) for 4-6 h, and the inducible constructs are induced as follows: (1) bacteria comprising a propionate gene cassette driven by a FNR-inducible promoter are induced in LB at 37 C for up to 4 hours in anaerobic conditions in a Coy anaerobic chamber (supplying 90% N2, 5% CO2, 5% H2, and 20 mM nitrate) at 37° C.; (2) bacteria comprising a propionate gene cassette driven by a tetracycline-inducible promoter are induced with anhydrotetracycline (100 ng/mL); (3) bacteria comprising a propionate gene cassette driven by a arabinose-inducible promoter are induced with 1% arabinose in media lacking glucose. One mL culture aliquots are prepared in 1.5 mL capped tubes and FNR-inducible constructs are incubated in a stationary incubator to limit culture aeration. One tube is removed at each time point (0, 1, 2, 4, and 20 hours) and analyzed for propionate concentration by LC-MS to confirm that propionate production in these recombinant strains can be achieved in a low-oxygen environment.

Example 7. Efficacy of Propionate-Expressing Bacteria in a Mouse Model of Obesity and Type 2 Diabetes Mellitus (T2DM)

For in vivo studies to assess the efficacy of the genetically engineered bacteria in an animal model of obesity and type 2 diabetes, C57BL/6J mice are fed a high fat diet (60 kcal % fat, Research Diets Inc.) starting from 4-5 weeks of age for 8 weeks or until body weight is at least 45 g in order to induce obesity and T2DM-related symptoms such as hyperinsulinemia and hyperglycemia, e.g., glycaemia above 160 mg/dL and plasma insulin above 4000 µg/mL. Alternatively, B6.BKS(D)-Lepr$^{db/db}$ mice (Lepr$^{db/db}$) are obtained from The Jackson Laboratory; these mice typically become obese and display T2DM-related symptoms beginning at 10 weeks of age.

Bacteria harboring the propionate gene cassette described above are grown overnight in LB. Bacteria are then diluted 1:100 into LB containing a suitable selection marker, e.g., ampicillin, and grown to an optical density of 0.4-0.5 and then pelleted by centrifugation. To analyze the efficacy of the bacteria in vivo, bacteria are resuspended in phosphate buffered saline (PBS) and 100 microliters is administered by oral gavage to mice daily for 8 weeks. Alternatively, the bacteria can be supplemented in the drinking water ($5 \times 10^9$ CFU bacteria/mL).

Body weight and food intake are measured weekly before, during, and after the administration of the bacteria. In addition, mice are subjected to insulin tolerance tests (ITT), glucose tolerance tests (GTT) and pyruvate tolerance tests (PTT) to determine the severity of T2DM during treatment, e.g., amelioration of insulin resistance. For ITT, mice are fasted overnight and injected with insulin (1 U/kg, diluted in PBS). Blood glucose levels are measured prior to the injection and at 20, 40, 60, and 90 min. post injection via tail bleeding. For GTT, mice are fasted overnight and injected with glucose solution (1 g/kg, dissolved in PBS); blood glucose levels are measured as described above in order to determine changes. For PTT, mice are fasted overnight and injected with sodium pyruvate solution (1 g/kg, dissolved in PBS); blood glucose levels are measured as described above. Whole-body metabolic functions are analyzed by placing the mice in a Comprehensive Lab Animal Monitoring System (CLAMS), which monitors physical activity, food intake, metabolic rate (as a function of $O_2$ consumption and $CO_2$ production). Mice are sacrificed and metabolic tissues such as liver, skeletal muscle, epididymal fat, subcutaneous fat, brown fat, pancreas, and brain, are collected for analysis of histology, e.g., Oil Red O staining of the liver, and gene expression.

Example 8. Nissle Residence

Unmodified *E. coli* Nissle and the genetically engineered bacteria of the invention may be destroyed, e.g., by defense factors in the gut or blood serum. The residence time of bacteria in vivo may be calculated. A non-limiting example using a streptomycin-resistant strain of *E. coli* Nissle is described below. In alternate embodiments, residence time is calculated for the genetically engineered bacteria of the invention.

C57BL/6 mice were acclimated in the animal facility for 1 week. After one week of acclimation (i.e., day 0), streptomycin-resistant Nissle (SYN-UCD103) was administered to the mice via oral gavage on days 1-3. Mice were not pre-treated with antibiotic. The amount of bacteria administered, i.e., the inoculant, is shown in Table 31. In order to determine the CFU of the inoculant, the inoculant was serially diluted, and plated onto LB plates containing streptomycin (300 µg/mL). The plates were incubated at 37° C. overnight, and colonies were counted.

TABLE 31

| CFU administered via oral gavage | | | |
|---|---|---|---|
| Strain | Day 1 | Day 2 | Day 3 |
| SYN-UCD103 | 1.30E+08 | 8.50E+08 | 1.90E+09 |

On days 2-10, fecal pellets were collected from up to 6 mice (ID NOs. 1-6; Table 14). The pellets were weighed in tubes containing PBS and homogenized. In order to determine the CFU of Nissle in the fecal pellet, the homogenized fecal pellet was serially diluted, and plated onto LB plates containing streptomycin (300 µg/mL). The plates were incubated at 37° C. overnight, and colonies were counted.

Fecal pellets from day 1 were also collected and plated on LB plates containing streptomycin (300 µg/mL) to determine if there were any strains native to the mouse gastrointestinal tract that were streptomycin resistant. The time course and amount of administered Nissle still residing within the mouse gastrointestinal tract is shown in Table 32.

Figure 65:
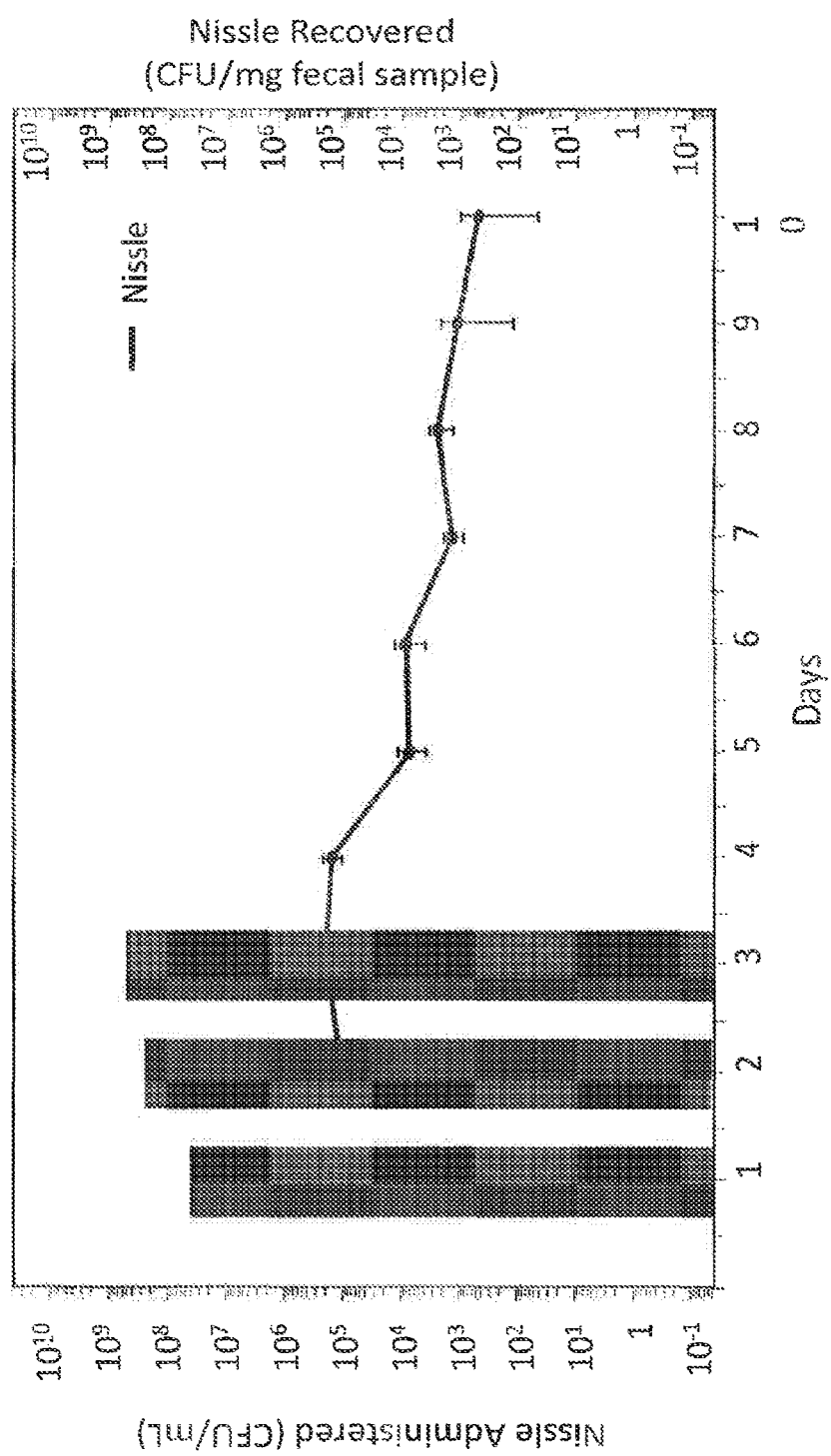
FIG. 65 depicts a graph of Nissle residence in vivo. Streptomycin-resistant Nissle was administered to mice via oral gavage without antibiotic pre-treatment. Fecal pellets from 6 total mice were monitored post-administration to determine the amount of administered Nissle still residing within the mouse gastrointestinal tract. The bars represent the number of bacteria administered to the mice. The line represents the number of Nissle recovered from the fecal samples each day for 10 consecutive days.

FIG. 65 depicts a graph of Nissle residence in vivo. Streptomycin-resistant Nissle was administered to mice via oral gavage without antibiotic pre-treatment. Fecal pellets from six total mice were monitored post-administration to determine the amount of administered Nissle still residing within the mouse gastrointestinal tract. The bars represent the number of bacteria administered to the mice. The line represents the number of Nissle recovered from the fecal samples each day for 10 consecutive days.

TABLE 32

| Nissle residence in vivo | | | | |
|---|---|---|---|---|
| ID | Day 2 | Day 3 | Day 4 | Day 5 |
| 1 | 2.40E+05 | 6.50E+03 | 6.00E+04 | 2.00E+03 |
| 2 | 1.00E+05 | 1.00E+04 | 3.30E+04 | 3.00E+03 |
| 3 | 6.00E+04 | 1.70E+04 | 6.30E+04 | 2.00E+02 |
| 4 | 3.00E+04 | 1.50E+04 | 1.10E+05 | 3.00E+02 |
| 5 | | 1.00E+04 | 3.00E+05 | 1.50E+04 |
| 6 | | 1.00E+06 | 4.00E+05 | 2.30E+04 |
| Avg | 1.08E+05 | 1.76E+05 | 1.61E+05 | 7.25E+03 |
| ID | Day 6 | Day 7 | Day 8 | Day 9 | Day 10 |
| 1 | 9.10E+03 | 1.70E+03 | 4.30E+03 | 6.40E+03 | 2.77E+03 |
| 2 | 6.00E+03 | 7.00E+02 | 6.00E+02 | 0.00E+00 | 0.00E+00 |
| 3 | 1.00E+02 | 2.00E+02 | 0.00E+00 | 0.00E+00 | 0.00E+00 |
| 4 | 1.50E+03 | 1.00E+02 | | 0.00E+00 | 0.00E+00 |
| 5 | 3.10E+04 | 3.60E+03 | | 0.00E+00 | 0.00E+00 |
| 6 | 1.50E+03 | 1.40E+03 | 4.20E+03 | 1.00E+02 | 0.00E+00 |
| Avg | 8.20E+03 | 1.28E+03 | 2.28E+03 | 1.08E+03 | 4.62E+02 |

Example 9. Intestinal Residence and Survival of Bacterial Strains In Vivo

Figure 66:
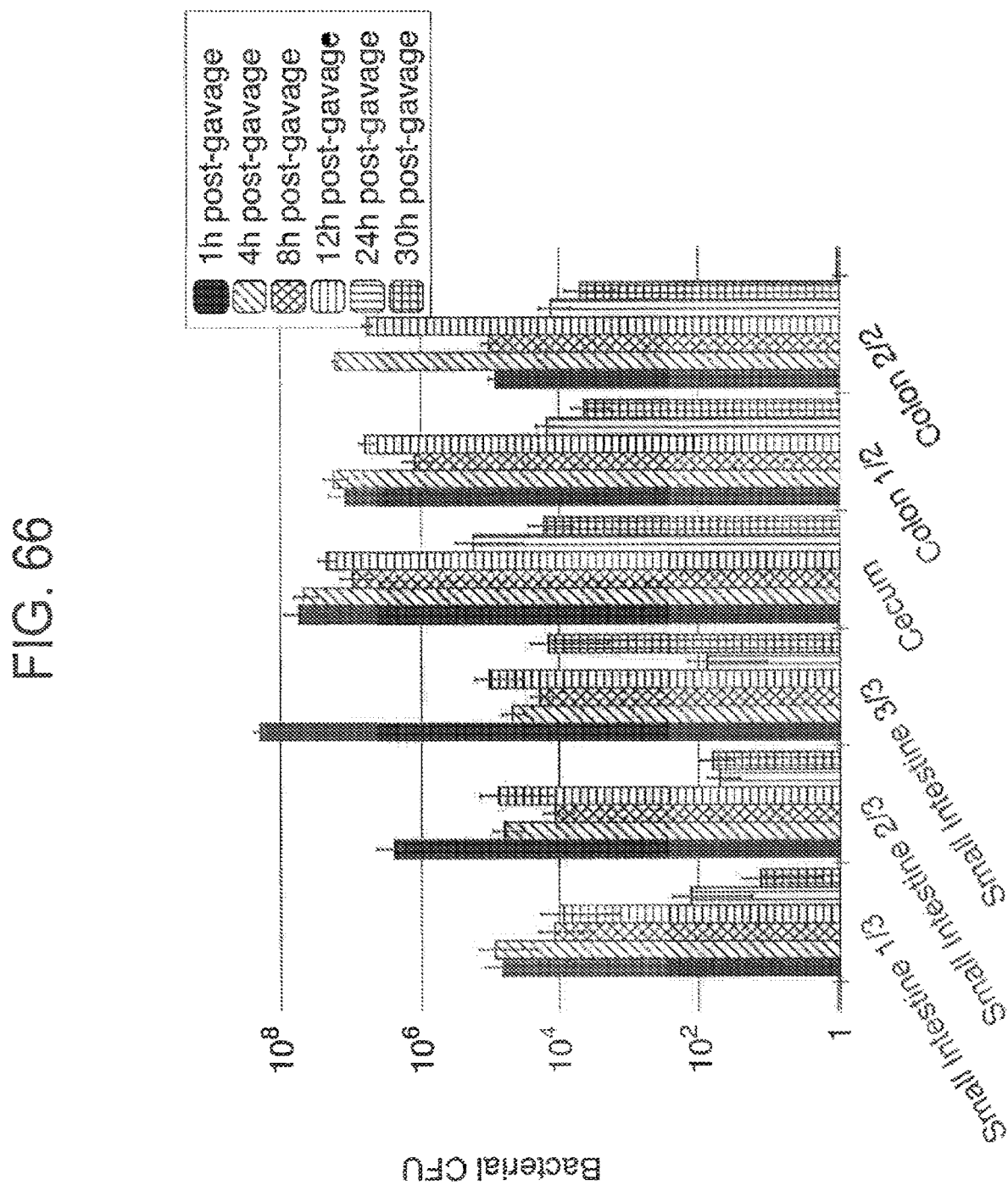
FIG. 66 depicts a bar graph of residence over time for streptomycin resistant Nissle in various compartments of the intestinal tract at 1, 4, 8, 12, 24, and 30 hours post gavage. Mice were treated with approximately 109 CFU, and at each timepoint, animals (n=4) were euthanized, and intestine, cecum, and colon were removed. The small intestine was cut into three sections, and the large intestine and colon each into two sections. Intestinal effluents gathered and CFUs in each compartment were determined by serial dilution plating.
Figure 67:
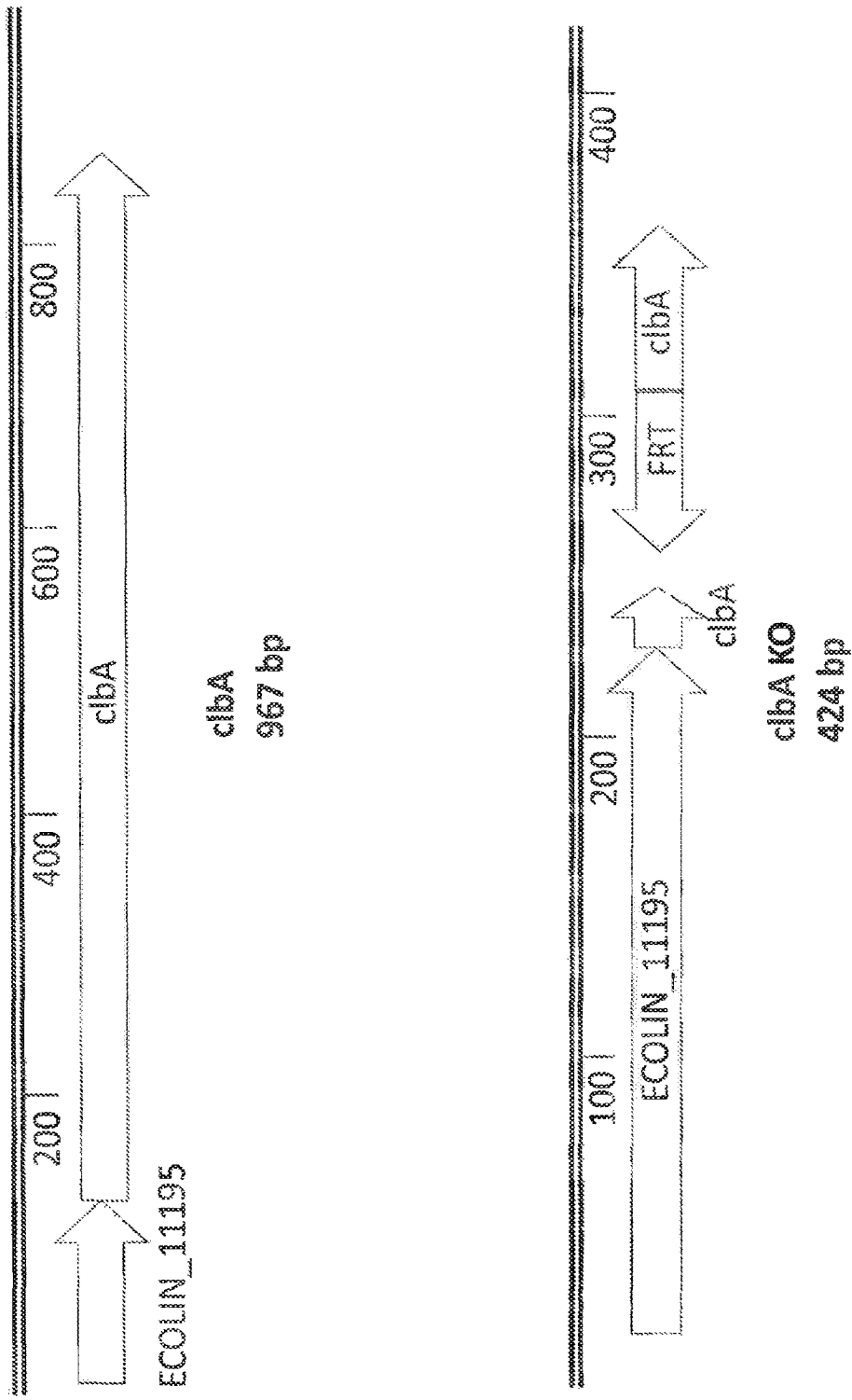
FIG. 67 depicts a schematic diagram of a wild-type clbA construct (upper panel) and a schematic diagram of a clbA knockout construct (lower panel).
Figure 68:
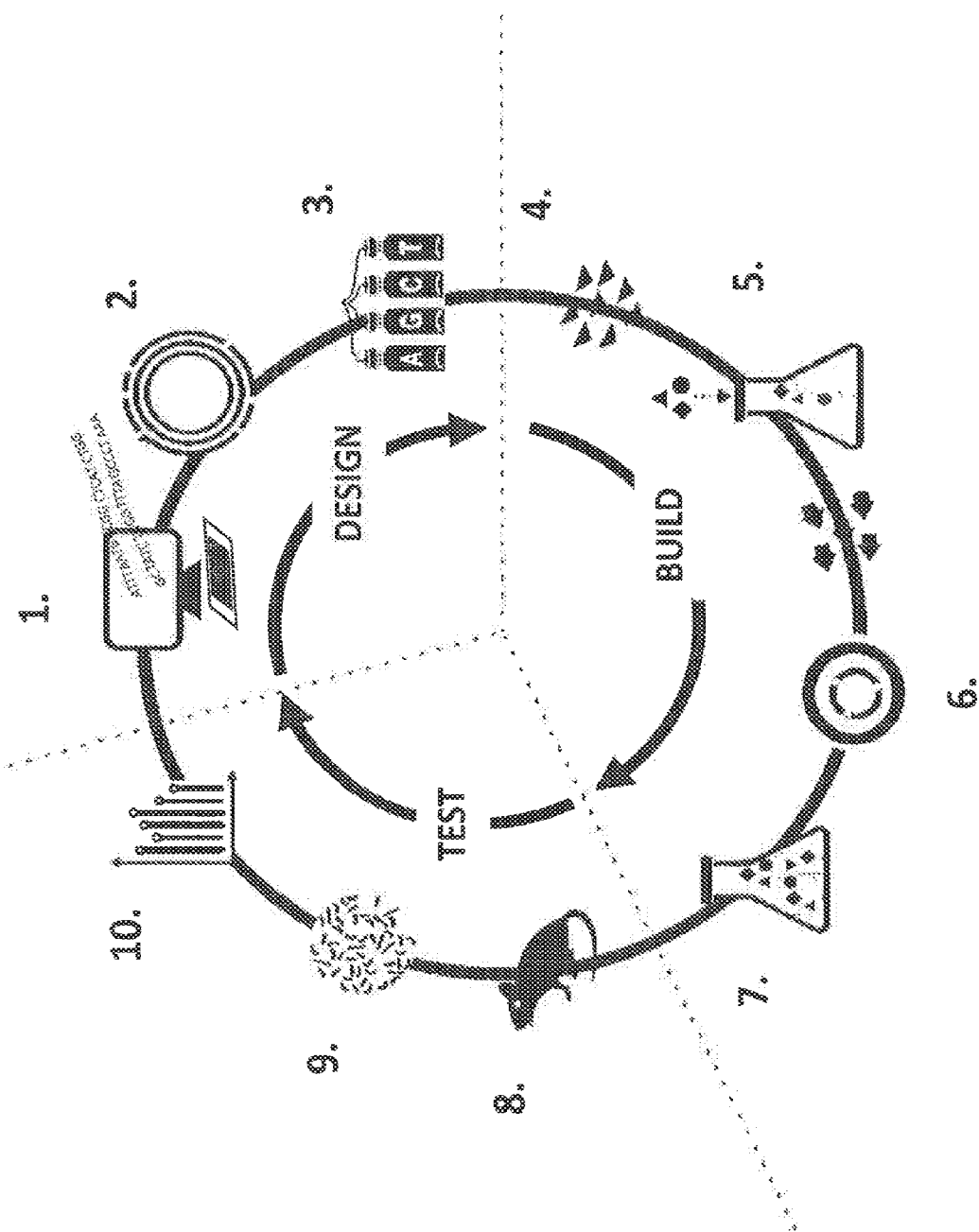
FIG. 68 depicts a schematic of a design-build-test cycle. Steps are as follows: 1: Define the disease pathway; 2. Identify target metabolites; 3. Design genetic circuits; 4. Build synthetic biotic; 5. Activate circuit in vivo; 6. Characterize circuit activation kinetics; 7. Optimize in vitro productivity to disease threshold; 8. Test optimize circuit in animal disease model; 9. Assimilate into the microbiome; 10. Develop understanding of in vivo PK and dosing regimen.

Localization and intestinal residence time of streptomycin resistant Nissle, FIG. 66) was determined. Mice were gavaged, sacrificed at various time points, and effluents were collected from various areas of the small intestine cecum and colon.

Bacterial cultures were grown overnight and pelleted. The pellets were resuspended in PBS at a final concentration of approximately $10^{10}$ CFU/mL. Mice (C57BL6/J, 10-12 weeks old) were gavaged with 100 μL of bacteria (approximately $10^9$ CFU). Drinking water for the mice was changed to contain 0.1 mg/mL anhydrotetracycline (ATC) and 5% sucrose for palatability. At each timepoint (1, 4, 8, 12, 24, and 30 hours post-gavage), animals (n=4) were euthanized, and intestine, cecum, and colon were removed. The small intestine was cut into three sections, and the large intestine and colon each into two sections. Each section was flushed with 0.5 ml cold PBS and collected in separate 1.5 ml tubes. The cecum was harvested, contents were squeezed out, and flushed with 0.5 ml cold PBS and collected in a 1.5 ml tube. Intestinal effluents were placed on ice for serial dilution plating.

In order to determine the CFU of bacteria in each effluent, the effluent was serially diluted, and plated onto LB plates containing kanamycin. The plates were incubated at 37° C. overnight, and colonies were counted. The amount of bacteria and residence time in each compartment is shown in FIG. 66.

Example 33. Construction of Vectors for Overproducing Butyrate

In addition to the ammonia conversion circuit, GABA transport circuit, GABA metabolic circuit, and/or manganese transport circuit described above, the *E. coli* Nissle bacteria further comprise one or more circuits for producing a gut barrier enhancer molecule.

To facilitate inducible production of butyrate in *E. coli* Nissle, the eight genes of the butyrate production pathway from *Peptoclostridium difficile* 630 (bcd2, etfB3, etfA3, thiA1, hbd, crt2, bpt, and buk; NCBI), as well as transcriptional and translational elements, were synthesized (Gen9, Cambridge, Mass.) and cloned into vector pBR322. The butyrate gene cassette is placed under the control of a FNR regulatory region selected from (SEQ ID NOs: 177-188) (Table 21) In certain constructs, the FNR-responsive promoter is further fused to a strong ribosome binding site sequence. For efficient translation of butyrate genes, each synthetic gene in the operon was separated by a 15 base pair ribosome binding site derived from the T7 promoter/translational start site.

In certain constructs, the butyrate gene cassette is placed under the control of an RNS-responsive regulatory region, e.g., norB, and the bacteria further comprises a gene encoding a corresponding RNS-responsive transcription factor, e.g., nsrR (see, e.g., Tables 33 and 34). In certain constructs, the butyrate gene cassette is placed under the control of an ROS-responsive regulatory region, e.g., oxyS, and the bacteria further comprises a gene encoding a corresponding ROS-responsive transcription factor, e.g., oxyR (see, e.g., Tables 14-17). In certain constructs, the butyrate gene cassette is placed under the control of a tetracycline-inducible or constitutive promoter.

TABLE 33

| pLogic031-nsrR-norB-butyrate construct (SEQ ID NO: 200) | |
|---|---|
| Description | Nucleotide sequences of pLogic031-nsrR-norB-butyrate construct (SEQ ID NO: 200) |
| Nucleic acid sequence of an exemplary RNS-regulated construct comprising a gene encoding nsrR, a regulatory region of norB, and a butyrogenic gene cassette (pLogic031-nsrR-norB-butyrate construct; SEQ ID NO: 79). The sequence encoding NsrR is underlined and bolded, and the NsrR binding site, i.e., a regulatory region of norB is boxed. | ttattatcgcaccgcaatcgggattttcgattcataaagcagg tcgtaggtcggcttgttgagcaggtcttgcagcgtgaaaccgt ccagatacgtgaaaaacgacttcattgcaccgccgagtatgcc cgtcagccggcaggacggcgtaatcaggcattcgttgttcggg cccatacactcgaccagctgcatcggttcgaggtggcggacga ccgcgccgatattgatgcgttcgggcggcgcggcagcctcag ccgccgcctttcccgcgtacgctgtgcaagaacccgcctttg accagcgcggtaaccactttcatcaaatggcttttggaaatgc cgtaggtcgaggcgatggtggcgatattgaccagcgcgtcgtc gttgacggcggtgtagatgaggacgcgcagcccgtagtcggta tgttgggtcagatacatacaacctccttagtacatgcaaaatt atttctagagcaacatacgagccggaagcataaagtgtaaagc ctgggggtgcctaatgagttgagtgaggaattataacaggaag aaatattcctcatacgcttgtaattcctctatggttgttgaca attaatcatcggctcgtataatg\|tataacattcatattttgtg aatttttaaa\|ctctagaaataatttttgtttaactttaagaagga gatatacatatggatttaaattctaaaaaatatcagatgctta aagagctatatgtaagcttcgctgaaaatgaagttaaacctt agcaacagaacttgatgaagaagaaagatttccttatgaaaca gtggaaaaaatggcaaaagcaggaatgatgggtataccatatc caaaagaatatggtggagaaggtggagacactgtaggatatat aatggcagttgaagaattgtctagagtttgtggtactacagga gttatattatcagctcatacatctcttggctcatggcctatat atcaatatggtaatgaagaacaaaaacaaaaattcttaagacc actagcaagtggagaaaaattaggagcatttggtcttactgag cctaatgctggtacagatgcgtctggccaacaaacaactgctg ttttagacggggatgaatacatacttaatggctcaaaaatatt tataacaaacgcaatagctggtgacatatatgtagtaatggca atgactgataaatctaagggaacaaaggaatatcagcattta tagttgaaaaaggaactcctgggtttagctttggagttaaaga aaagaaaatgggtataagaggttcagctacgagtgaattaata tttgaggattgcagaatacctaaagaaaatttacttggaaaag aaggtcaaggatttaagatagcaatgtctactcttgatggtgg tagaattggtatagctgcacaagcttttagtttagcacaaggt gctcttgatgaaactgttaaatatgtaaaagaaagagtacaat ttggtagaccattatcaaaattccaaaatacacaattccaatt agctgatatggaagttaaggtacaagcggctagacaccttgta tatcaagcagctataaataaagacttaggaaaaaccttatggag tagaagcagcaatggcaaaattatttgcagctgaaacagctat |

TABLE 33-continued

| pLogic031-nsrR-norB-butyrate construct (SEQ ID NO: 200) | |
|---|---|
| Description | Nucleotide sequences of pLogic031-nsrR-norB-butyrate construct (SEQ ID NO: 200) |
| | ggaagttactacaaaagctgtacaacttcatggaggatatgga<br>tacactcgtgactatccagtagaaagaatgatgagagatgcta<br>agataactgaaatatatgaaggaactagtgaagttcaaagaat<br>ggttatttcaggaaaactattaaaatagtaagaaggagatata<br>catatggaggaaggatttatgaatatagtcgtttgtataaaac<br>aagttccagatacaacagaagttaaactagatcctaatacagg<br>tactttaattagagatggagtaccaagtataataaaccctgat<br>gataaagcaggtttagaagaagctataaaattaaaagaagaaa<br>tgggtgctcatgtaactgttataacaatgggacctcctcaagc<br>agatatggcttttaaaagaagctttagcaatgggtgcagataga<br>ggtatattattaacagatagagcatttgcgggtgctgatactt<br>gggcaacttcatcagcattagcaggagcattaaaaaatataga<br>ttttgatattataatagctggaagacaggcgatagatggagat<br>actgcacaagttggacctcaaatagctgaacatttaaatcttc<br>catcaataacatatgctgaagaaataaaaactgaaggtaata<br>tgtattagtaaaaagacaatttgaagattgttgccatgactta<br>aaagttaaaatgccatgccttataacaactcttaaagatatga<br>acacaccaagatacatgaaagttggaagaatatatgatgcttt<br>cgaaaatgatgtagtagaaacatggactgtaaaagatatagaa<br>gttgacccttctaatttaggtcttaaaggttctccaactagtg<br>tatttaaatcatttacaaaatcagttaaaccagctggtacaat<br>atacaatgaagatgcgaaaacatcagctggaattatcatagat<br>aaattaaaagagaagtatatcatataataagaaggagatatac<br>atatgggtaacgttttagtagtaataagaacaaagagaaaatgt<br>aattcaaactgtttctttagaattactaggaaaggctacagaa<br>atagcaaaagattatgatacaaaagtttctgcattacttttag<br>gtagtaaggtagaaggtttaatagatacattagcacactatgg<br>tgcagatgaggtaatagtagtagatgatgaagctttagcagtg<br>tatacaactgaaccatatacaaaagcagcttatgaagcaataa<br>aagcagctgaccctatagttgtattatttggtgcaacttcaat<br>aggtagagatttagcgcctagagtttctgctagaatacataca<br>ggtcttactgctgactgtacaggtcttgcagtagctgaagata<br>caaaattattattaatgacaagacctgcctttggtggaaatat<br>aatggcaacaatagtttgtaaagatttcagacctcaaatgtct<br>acagttagaccaggggttatgaagaaaaatgaacctgatgaaa<br>ctaaagaagctgtaattaaccgtttcaaggtagaatttaatga<br>tgctgataaattagttcaagttgtacaagtaataaaagaagct<br>aaaaaacaagttaaaatagaagatgctaagatattagtttctg<br>ctggacgtggaatgggtggaaaagaaaacttagacatacttta<br>tgaattagctgaaattataggtggagaagtttctggttctcgt<br>gccactatagatgcaggttggttagataaagcaagacaagttg<br>gtcaaactggtaaaactgtaagaccagaccctttatatagcatg<br>tggtatatctggagcaatacaacatatagctggtatggaagat<br>gctgagtttatagttgctataataaaaatccagaagctccaa<br>tatttaaatatgctgatgttggtatagttggagatgttcataa<br>agtgcttccagaacttatcagtcagttaagtgttgcaaaagaa<br>aaaggtgaagttttagctaactaataagaaggagatatacata<br>tgagagaagtagtaattgccagtgcagctagaacagcagtagg<br>aagttttggaggagcatttaaatcagtttcagcggtagagtta<br>ggggtaacagcagctaaagaagctataaaaagagctaacataa<br>ctccagatatgatagatgaatctcttttagggggagtacttac<br>agcaggtcttggacaaaatatagcaagacaaatagcattagga<br>gcaggaataccagtagaaaaaccagctatgactataaatatag<br>tttgtggttctggattaagatctgtttcaatggcatctcaact<br>tatagcattaggtgatgctgatataatgttagttggtggagct<br>gaaaacatgagtatgtctccttatttagtaccaagtgcgagat<br>atggtgcaagaatgggtgatgctgcttttgttgattcaatgat<br>aaaagatggattatcagacatatttaataactatcacatggt<br>attactgctgaaaacatagcagagcaatggaatataactagag<br>aagaacaagatgaattagctcttgcaagtcaaaataaagctga<br>aaaagctcaagctgaaggaaatttgatgaagaaatagttcct<br>gttgttataaaaggaagaaaaggtgacactgtagtagataaag<br>atgaatatattaagcctggcactacaatggagaaacttgctaa<br>gttaagacctgcatttaaaaaagatggaacagttactgctggt<br>aatgcatcaggaataaatgatggtgctgctatgttagtagtaa<br>tggctaaagaaaaagctgaagaactaggaatagagcctcttgc<br>aactatagtttcttatggaacagctggtgttgaccctaaaata<br>atgggatatggaccagttccagcaactaaaaaagctttagaag<br>ctgctaatatgactattgaagatatagatttagttgaagctaa<br>tgaggcatttgctgcccaatctgtagctgtaataagagactta<br>aatatagatatgaataaagttaatgttaatggtggagcaatag<br>ctataggacatccaataggatgctcaggagcaagaatacttac<br>tacactttatatgaaatgaagagaagagatgctaaaactggt<br>cttgctacactttgtataggcggtggaatgggaactactttaa<br>tagttaagagatagtaagaaggagatatacatatgaaaattagc |

TABLE 33-continued pLogic031-nsrR-norB-butyrate construct (SEQ ID NO: 200)

| Description | Nucleotide sequences of pLogic031-nsrR-norB-butyrate construct (SEQ ID NO: 200) |
|---|---|
| | tgtaataggtagtggaactatgggaagtggtattgtacaaact<br>tttgcaagttgtggacatgatgtatgtttaaagagtagaactc<br>aaggtgctatagataaatgtttagctttattagataaaaattt<br>aactaagttagttactaagggaaaaatggatgaagctacaaaa<br>gcagaaatattaagtcatgttagttcaactactaattatgaag<br>atttaaaagatatggatttaataatagaagcatctgtagaaga<br>catgaatataaagaaagatgttttcaagttactagatgaatta<br>tgtaaagaagatactatcttggcaacaaatacttcatcattat<br>ctataacagaaatagcttcttctactaagcgcccagataaagt<br>tataggaatgcatttctttaatccagttcctatgatgaaatta<br>gttgaagttataagtggtcagttaacatcaaaagttacttttg<br>atacagtatttgaattatctaagagtatcaataaagtaccagt<br>agatgtatctgaatctcctggatttgtagtaaatagaatactt<br>atacctatgataaatgaagctgttggtatatatgcagatggtg<br>ttgcaagtaaagaagaaatagatgaagctatgaaattaggagc<br>aaaccatccaatgggaccactagcattaggtgatttaatcgga<br>ttagatgttgttttagctataatgaacgttttatatactgaat<br>ttggagatactaaatatagacctcatccacttttagctaaaat<br>ggttagagctaatcaattaggaagaaaaactaagataggattc<br>tatgattataataaataataagaaggagatatacatatgagta<br>caagtgatgttaaagtttatgagaatgtagctgttgaagtaga<br>tggaaatatatgtacagtgaaaatgaatagacctaaagccctt<br>aatgcaataaattcaaagactttagaagaactttatgaagtat<br>ttgtagatattaataatgatgaaactattgatgttgtaatatt<br>gacaggggaaggaaaggcatttgtagctggagcagatattgca<br>tacatgaaagatttagatgctgtagctgctaaagattttagta<br>tcttaggagcaaaagcttttggagaaatagaaaatagtaaaaa<br>agtagtgatagctgctgtaaacggatttgctttaggtggagga<br>tgtgaacttgcaatggcatgtgatataagaattgcatctgcta<br>aagctaaatttggtcagccagaagtaactcttggaataactcc<br>aggatatggaggaactcaaaggcttacaagattggttggaatg<br>gcaaaagcaaaagaattaatctttacaggtcaagttataaaag<br>ctgatgaagctgaaaaaatagggctagtaaatagagtcgttga<br>gccagacatttaataagaagttgagaaattagctaagata<br>atagctaaaaatgctcagcttgcagttagatactctaaagaag<br>caatacaacttggtgctcaaactgatataaatactggaataga<br>tatagaatctaatttatttggtcttgttttcaactaaagac<br>caaaaagaaggaatgtcagctttcgttgaaaagagagaagcta<br>actttataaaagggtaataagaaggagatatacatatgagaag<br>ttttgaagaagtaattaagtttgcaaaagaaagaggacctaaa<br>actatatcagtagcatgttgccaagataaagaagttttaatgg<br>cagttgaaatggctagaaaagaaaaaatagcaaatgccatttt<br>agtaggagatatagaaaagactaaagaaattgcaaaaagcata<br>gacatggatatcgaaaattatgaactgatagatataaagatt<br>tagcagaagcatctctaaaatctgttgaattagtttcacaagg<br>aaaagccgacatggtaatgaaaggcttagtagacacatcaata<br>atactaaaagcagttttaaataaagaagtaggtcttagaactg<br>gaaatgtattaagtcacgtagcagtatttgatgtagagggata<br>tgatagattattttttcgtaactgacgcagctatgaacttagct<br>cctgatacaaatactaaaaagcaaatcatagaaaatgcttgca<br>cagtagcacattcattagatataagtgaaccaaaagttgctgc<br>aatatgcgcaaaagaaaagtaaatccaaaaatgaaagataca<br>gttgaagctaaagaactagaagaaatgtatgaaagaggagaaa<br>tcaaaggttgtatggttggtgggccttttgcaattgataatgc<br>agtatctttagaagcagctaaacataaaggtataaatcatcct<br>gtagcaggacgagctgatatattattagccccagatattgaag<br>gtggtaacatattatataaagctttggtattcttctcaaaatc<br>aaaaaatgcaggagttatagttggggctaaagcaccaataata<br>ttaacttctagagcagacagtgaagaaactaaactaaactcaa<br>tagctttaggtgttttaatggcagcaaaggcataataagaagg<br>agatatacatatgagcaaaatatttaaaatcttaacaataaat<br>cctggttcgacatcaactaaaatagctgtatttgataatgagg<br>atttagtatttgaaaaaactttaagacattcttcagaagaaat<br>aggaaaatatgagaaggtgtctgaccaatttgaatttcgtaaa<br>caagtaatagaagaagctctaaaagaaggtggagtaaaaacat<br>ctgaattagatgctgtagtaggtagaggaggacttcttaaacc<br>tataaaaggtggtacttattcagtaagtgctgctatgattgaa<br>gatttaaaagtgggagttttaggagaacacgcttcaaacctag<br>gtggaataatagcaaacaaataggtgaagaagtaaatgttcc<br>ttcatacatagtagaccctgttgttgtagatgaattagaagat<br>gttgctagaatttctggtatgcctgaaataagtagagcaagtg<br>tagtacatgcttaaatcaaaaggcaatagcaagaagatatgc<br>tagagaaataaacaagaaatatgaagatataaatcttatagtt<br>gcacacatgggtggaggagtttctgttggagctcataaaaatg<br>gtaaaatagtagatgttgcaaacgcattagatggagaaggacc |

TABLE 33-continued pLogic031-nsrR-norB-butyrate construct (SEQ ID NO: 200)

| Description | Nucleotide sequences of pLogic031-nsrR-norB-butyrate construct (SEQ ID NO: 200) |
|---|---|
| | tttctctccagaaagaagtggtggactaccagtaggtgcatta<br>gtaaaaatgtgctttagtggaaaatatactcaagatgaatta<br>aaagaaaataaaaggtaatggcggactagttgcatacttaaa<br>cactaatgatgctagagaagttgaagaaagaattgaagctggt<br>gatgaaaaagctaaattagtatatgaagctatggcatatcaaa<br>tctctaaagaaataggagctagtgctgcagttcttaagggaga<br>tgtaaaagcaatattattaactggtggaatcgcatattcaaaa<br>atgtttacagaaatgattgcagatagagttaaatttatagcag<br>atgtaaaagtttatccaggtgaagatgaaatgattgcattagc<br>tcaaggtggacttagagttttaactggtgaagaagaggctcaa<br>gtttatgataactaataa |

TABLE 34

Nucleotide sequences of pLogic046-nsrR-norB-butyrate construct

| Description | Nucleotide sequences of pLogic046-nsrR-norB-butyrate construct (SEQ ID NO: 201) |
|---|---|
| Nucleic acid sequence of an exemplary RNS-regulated construct comprising a gene encoding nsrR, a regulatory region of norB, and a butyrogenic gene cassette (pLogic046-nsrR-norB-butyrate construct; SEQ ID NO: 80). | ttattatcgcaccgcaatcgggattttcgattcataaagcaggtc<br>gtaggtcggcttgttgagcaggtcttgcagcgtgaaaccgtccag<br>atacgtgaaaaacgacttcattgcaccgccgagtatgcccgtcag<br>ccggcaggacggcgtaatcaggcattcgttgttcgggcccataca<br>ctcgaccagctgcatcggttcgaggtggcggacgaccgcgccgat<br>attgatgcgttcgggcggcgcggccagcctcagcccgccgccttt<br>cccgcgtacgctgtgcaagaacccgcctttgaccagccgcggtaac<br>cactttcatcaaatggcttttggaaatgccgtaggtcgaggcgat<br>ggtggcgatattgaccagcgcgtcgtcgttgacggcggtgtagat<br>gaggacgcgcagcccgtagtcggtatgttgggtcagatacataca<br>acctccttagtacatgcaaaattatttctagagcaacatacgagc<br>cggaagcataaagtgtaaagcctgggtgcctaatgagttgagtt<br>gaggaattataacaggaagaaatattcctcatacgcttgtaattc<br>ctctatggttgttgacaattaatcatcggctcgtataatg⎡cataa<br>cattcatattttgtgaatttta aaa⎦ctctagaaataattttgttta<br>actttaagaaggagatatacatatgatcgtaaaacctatggtacg<br>caacaatatctgcctgaacgcccatcctcagggctgcaagaaggg<br>agtggaagatcagattgaatataccaagaaacgcattaccgcaga<br>agtcaaagctggcgcaaaagctccaaaaaacgttctggtgcttgg<br>ctgctcaaatggttacggcctggcgagccgcattactgctgcgtt<br>cggatacggggctgcgaccatcggcgtgtcctttgaaaaagcggg<br>ttcagaaaccaaatatggtacaccgggatggtacaataatttggc<br>atttgatgaagcggcaaaacgcgagggtctttatagcgtgacgat<br>cgacggcgatgcgttttcagacgagatcaaggcccaggtaattga<br>ggaagccaaaaaaaaggtatcaaatttgatctgatcgtatacag<br>cttggccagcccagtacgtactgatcctgatacaggtatcatgca<br>caaaagcgttttgaaacccttttggaaaaacgttcacaggcaaaac<br>agtagatccgtttactggcgagctgaaggaaatctccgcggaacc<br>agcaaatgacgaggaagcagccgccactgttaaagttatgggggg<br>tgaagattgggaacgttggattaagcagctgtcgaaggaaggcct<br>cttagaagaaggctgtattaccttggcctatagttatattggccc<br>tgaagctacccaagctttgtaccgtaaaggcacaatcggcaaggc<br>caaagaacacctggaggccacagcacaccgtctcaacaaagagaa<br>cccgtcaatccgtgccttcgtgagcgtgaataaaggcctggtaac<br>ccgcgcaagcgccgtaatcccggtaatccctctgtatctcgccag<br>cttgttcaaagtaatgaaagagaagggcaatcatgaaggttgtat<br>tgaacagatcacgcgtctgtacgccgagcgcctgtaccgtaaaga<br>tggtacaattccagttgatgaggaaaatcgcattcgcattgatga<br>ttgggagttagaagaagacgtccagaaagcggtatccgcgttgat<br>ggagaaagtcacgggtgaaaacgcagaatctctcactgacttagc<br>ggggtaccgccatgatttcttagctagtaacggctttgatgtaga<br>aggtattaattatgaagcggaagttgaacgcttcgaccgtatctg<br>ataagaaggagatatacatatgagagaagtagtaattgccagtgc<br>agctagaacagcagtaggaagttttggaggagcatttaaatcagt<br>ttcagcggtagagttaggggtaacagcagctaaagaagctataaa<br>aagagctaacataactccagatatgatagatgaatctcttttagg<br>gggagtacttacagcaggtcttggacaaaatatagcaagacaaat<br>agcattaggagcaggaataccagtagaaaaaccagctatgactat<br>aaatatagtttgtggttctggattaagatctgtttcaatggcatc<br>tcaacttatagcattaggtgatgctgatataatgttagttggtgg<br>agctgaaaacatgagtatgtctccttatttagtaccaagtgcgag<br>atatgtgcaagaatgggtgatgctgcttttgttgattcaatgat |

TABLE 34-continued

Nucleotide sequences of pLogic046-nsrR-norB-butyrate construct

| Description | Nucleotide sequences of pLogic046-nsrR-norB-butyrate construct(SEQ ID NO: 201) |
|---|---|
| | aaaagatggattatcagacatatttaataactatcacatgggtat |
| | tactgctgaaaacatagcagagcaatggaatataactagagaaga |
| | acaagatgaattagctcttgcaagtcaaaataaagctgaaaaagc |
| | tcaagctgaaggaaaatttgatgaagaaatagttcctgttgttat |
| | aaaaggaagaaaaggtgacactgtagtagataaagatgaatatat |
| | taagcctggcactacaatggagaaacttgctaagttaagacctgc |
| | atttaaaaaagatggaacagttactgctggtaatgcatcaggaat |
| | aaatgatggtgctgctatgttagtagtaatggctaaagaaaaagc |
| | tgaagaactaggaatagagcctcttgcaactatagtttcttatgg |
| | aacagctggtgttgaccctaaaataatgggatatggaccagttcc |
| | agcaactaaaaaagctttagaagctgctaatatgactattgaaga |
| | tatagatttagttgaagctaatgaggcatttgctgcccaatctgt |
| | agctgtaataagagacttaaatatagatatgaataaagttaatgt |
| | taatggtggagcaatagctataggacatccaataggatgctcagg |
| | agcaagaatacttactacacttttatatgaaatgaagagaagaga |
| | tgctaaaactggtcttgctcacactttgtataggcggtggaatggg |
| | aactactttaatagttaagagatagtaagaaggagatatacatat |
| | gaaattagctgtaataggtagtggaactatgggaagtggtattgt |
| | acaaacttttgcaagttgtggacatgatgtatgtttaaagagtag |
| | aactcaaggtgctatagataaatgtttagctttattagataaaaa |
| | tttaactaagttagttactaagggaaaaatggatgaagctacaaa |
| | agcagaaatattaagtcatgttagttcaactactaattatgaaga |
| | tttaaaagatatggatttaataatagaagcatctgtagaagacat |
| | gaatataaagaaagatgttttcaagttactagatgaattatgtaa |
| | agaagatactatcttggcaacaaatacttcatcattatctataac |
| | agaaatagcttcttctactaagcgcccagataaagttataggaat |
| | gcatttctttaatccagttcctatgatgaaattagttgaagttat |
| | aagtggtcagttaacatcaaaagttacttttgatacagtatttga |
| | attatctaagagtatcaataaagtaccagtagatgtatctgaatc |
| | tcctggatttgtagtaaatagaatacttatacctatgataaatga |
| | agctgttggtatatatgcagatggtgttgcaagtaaagaagaaat |
| | agatgaagctatgaaattaggagcaaaccatccaatgggaccact |
| | agcattaggtgatttaatcggattagatgttgttttagctataat |
| | gaacgttttatatactgaatttggagatactaaatatagacctca |
| | tccacttttagctaaaatggttagagctaatcaattaggaagaaa |
| | aactaagataggattctatgattataataaataataagaaggaga |
| | tatacatatgagtacaagtgatgttaaagtttatgagaatgtagc |
| | tgttgaagtagatggaaatatatgtacagtgaaaatgaatagacc |
| | taaagcccttaatgcaataaattcaaagactttagaagaaccttta |
| | tgaagtatttgtagatattaataatgatgaaactattgatgttgt |
| | aatattgacaggggaaggaaaggcatttgtagctggagcagatat |
| | tgcatacatgaaagatttagatgctgtagctgctaaagattttag |
| | tatcttaggagcaaaagcttttggagaaatagaaaatagtaaaaa |
| | agtagtgatagctgctgtaaacggatttgctttaggtggaggatg |
| | tgaacttgcaatggcatgtgatataagaattgcatctgctaaagc |
| | taaatttggtcagccagaagtaactcttggaataactccaggata |
| | tggaggaactcaaaggcttacaagattggttggaatggcaaaagc |
| | aaaagaattaatctttacaggtcaagttataaaagctgatgaagc |
| | tgaaaaaatagggctagtaaatagagtcgttgagccagacatttt |
| | aatagaagaagttgagaaattagctaagataatagctaaaaatgc |
| | tcagcttgcagttagatactctaaagaagcaatacaacttggtgc |
| | tcaaactgatataaatactggaatagatatagaatctaatttatt |
| | tggtctttgtttttcaactaaagaccaaaaagaaggaatgtcagc |
| | tttcgttgaaaagagagaagctaactttataaaagggtaataaga |
| | aggagatatacatatgagaagttttgaagaagtaattaagtttgc |
| | aaaagaagaggacctaaaactatatcagtagcatgttgccaaga |
| | taaagaagttttaatggcagttgaaatggctagaaaagaaaaaat |
| | agcaaatgccattttagtaggagatatagaaaaagactaaagaaat |
| | tgcaaaaagcatagacatggatatcgaaaattatgaactgataga |
| | tataaaagatttagcagaagcatctctaaaatctgttgaattagt |
| | ttcacaaggaaaagccgacatggtaatgaaaggcttagtagacac |
| | atcaataatactaaaagcagttttaaataaagaagtaggtcttag |
| | aactggaaatgtattaagtcacgtagcagtatttgatgtagaggg |
| | atatgatagattattttttcgtaactgacgcagctatgaacttagc |
| | tcctgatacaaatactaaaaagcaaatcatagaaaatgcttgcac |
| | agtagcacattcattagatataagtgaaccaaaagttgctgcaat |
| | atgcgcaaaagaaaaagtaaatccaaaaatgaaagatacagttga |
| | agctaaagaactagaagaaatgtatgaaagaggagaaatcaaagg |
| | ttgtatggttggtgggccttttgcaattgataatgcagtatcttt |
| | agaagcagctaaacataaaggtataaatcatcctgtagcaggacg |
| | agctgatatattattagccccagatattgaaggtggtaacatatt |
| | atataaagctttggtattcttctcaaaatcaaaaaatgcaggagt |
| | tatagttggggctaaagcaccaataatattaacttctagagcaga |
| | cagtgaagaaactaaactaaactcaatagctttaggtgttttaat |
| | ggcagcaaaggcataataagaaggagatatacatatgagcaaaat |

TABLE 34-continued

Nucleotide sequences of pLogic046-nsrR-norB-butyrate construct

| Description | Nucleotide sequences of pLogic046-nsrR-norB-butyrate construct(SEQ ID NO: 201) |
|---|---|
| | atttaaaatcttaacaataaatcctggttcgacatcaactaaaat<br>agctgtatttgataatgaggatttagtatttgaaaaaactttaag<br>acattcttcagaagaaataggaaaatatgagaaggtgtctgacca<br>atttgaatttcgtaaacaagtaatagaagaagctctaaaagaagg<br>tggagtaaaaacatctgaattagatgctgtagtaggtagaggagg<br>acttcttaaacctataaaaggtggtacttattcagtaagtgctgc<br>tatgattgaagatttaaaagtgggagttttaggagaacacgcttc<br>aaacctaggtggaataatagcaaaacaaataggtgaagaagtaaa<br>tgttccttcatacatagtagaccctgttgttgtagatgaattaga<br>agatgttgctagaatttctggtatgcctgaaataagtagagcaag<br>tgtagtacatgctttaaatcaaaaggcaatagcaagaagatatgc<br>tagagaaataaacaagaaatatgaagatataaatcttatagttgc<br>acacatgggtggaggagtttctgttggagctcataaaaatggtaa<br>aatagtagatgttgcaaacgcattagatggagaaggaccttctc<br>tccagaaagaagtggtggactaccagtaggtgcattagtaaaaat<br>gtgctttagtggaaaatatactcaagatgaaattaaaaagaaaat<br>aaaaggtaatggcggactagttgcatacttaaacactaatgatgc<br>tagagaagttgaagaaagaattgaagctggtgatgaaaaagctaa<br>attagtatatgaagctatggcatatcaaatctctaaagaaatagg<br>agctagtgctgcagttcttaagggagatgtaaaagcaatattatt<br>aactggtggaatcgcatattcaaaaatgtttacagaaatgattgc<br>agatagagttaaatttatagcagatgtaaaagtttatccaggtga<br>agatgaaatgattgcattagctcaaggtggacttagagttttaac<br>tggtgaagaagaggctcaagtttatgataactaataa |

The gene products of the bcd2-etfA3-etfB3 genes form a complex that converts crotonyl-CoA to butyryl-CoA and may exhibit dependence on oxygen as a co-oxidant. Because the recombinant bacteria of the invention are designed to produce butyrate in an oxygen-limited environment (e.g. the mammalian gut), that dependence on oxygen could have a negative effect of butyrate production in the gut. It has been shown that a single gene from *Treponema denticola*, trans-2-enoynl-CoA reductase (ter), can functionally replace this three gene complex in an oxygen-independent manner. Therefore, a second butyrate gene cassette in which the ter gene replaces the bcd2-etfA3-etfB3 genes of the first butyrate cassette is synthesized (Genewiz, Cambridge, Mass.). The ter gene is codon-optimized for *E. coli* codon usage using Integrated DNA Technologies online codon optimization tool (https://www.idtdna.com/CodonOpt). The second butyrate gene cassette, as well as transcriptional and translational elements, is synthesized (Gen9, Cambridge, Mass.) and cloned into vector pBR322. The second butyrate gene cassette is placed under control of a FNR regulatory region as described above. In certain constructs, the butyrate gene cassette is placed under the control of an RNS-responsive regulatory region, e.g., norB, and the bacteria further comprises a gene encoding a corresponding RNS-responsive transcription factor, e.g., nsrR (see, e.g., Table 22). In certain constructs, the butyrate gene cassette is placed under the control of an ROS-responsive regulatory region, e.g., oxyS, and the bacteria further comprises a gene encoding a corresponding ROS-responsive transcription factor, e.g., oxyR (see, e.g., Table 23 and Table 35).

TABLE 35

ROS regulated constructs, OxyR construct, Tet-regulated constructs

| Description | Sequence |
|---|---|
| Nucleotide sequences of pLogic031-oxyS-butyrate construct (SEQ ID NO: 202) | ctcgagttcattatccatcctccatcgccacgatagttcatggcgataggtaga<br>atagcaatgaacgattatccctatcaagcattctgactgataattgctcacacg<br>aattcattaaagaggagaaaggtaccatggatttaaattctaaaaaatatcaga<br>tgcttaaagagctatatgtaagcttcgctgaaaatgaagttaaacctttagcaa<br>cagaacttgatgaagaagaaagatttccttatgaaacagtggaaaaaatggcaa<br>aagcaggaatgatgggtataccatatccaaaagaatatggtggagaaggtggag<br>acactgtaggatatataatggcagttgaagaattgtctagagtttgtggtacta<br>caggagttatattatcagctcatacatctcttggctcatggcctatatatcaat<br>atggtaatgaagaacaaaaacaaaaattcttaagaccactagcaagtggagaaa<br>aattaggagcatttggtcttactgagcctaatgctggtacagatgcgtctggcc<br>aacaaacaactgctgttttagacggggatgaatacatacttaatggctcaaaaa<br>tatttataacaaacgcaatagctggtgacatatatgtagtaatggcaatgactg<br>ataaatctaaggggaacaaaggaatatcagcatttatagttgaaaaaggaactc<br>ctgggtttagctttggagttaaagaaaagaaaatgggtataagaggttcagcta<br>cgagtgaattaatatttgaggattgcagaatacctaaagaaaatttacttggaa<br>aagaaggtcaaggatttaagatagcaatgtctactcttgatggtggtagaattg<br>gtatagctgcacaagctttaggtttagcacaaggtgctcttgatgaaactgtta<br>aatatgtaaaagaaagagtacaatttggtagaccattatcaaaattccaaaata<br>cacaattccaattagctgatatggaagttaaggtacaagcggctagacaccttg<br>tatatcaagcagctataaataaagacttaggaaaaccttatggagtagaagcag<br>caatggcaaaattatttgcagctgaaacagctatggaagttactacaaaagctg<br>tacaacttcatggaggatatggatacactcgtgactatccagtagaaagaatga |

TABLE 35 -continued

ROS regulated constructs, OxyR construct, Tet-regulated constructs

| Description | Sequence |
|---|---|
| | tgagagatgctaagataactgaaatatatgaaggaactagtgaagttcaaagaa
tggttatttcaggaaaactattaaaatagtaagaaggagatatacatatggagg
aaggatttatgaatatagtcgtttgtataaaacaagttccagatacaacagaag
ttaaactagatcctaatacaggtactttaattagagatggagtaccaagtataa
taaaccctgatgataaagcaggtttagaagaagctataaaattaaaagaagaaa
tgggtgctcatgtaactgttataacaatgggacctcctcaagcagatatggctt
taaaagaagctttagcaatgggtgcagatagaggtatattattaacagatagag
catttgcgggtgctgatacttgggcaacttcatcagcattagcaggagcattaa
aaaatatagattttgatattataatagctggaagacaggcgatagatggagata
ctgcacaagttggacctcaaatagctgaacatttaaatcttccatcaataacat
atgctgaagaaataaaaactgaaggtgaatatgtattagtaaaaagacaatttg
aagattgttgccatgacttaaaagttaaaatgccatgccttataacaactctta
aagatatgaacacaccaagatacatgaaagttggaagaatatatgatgctttcg
aaaatgatgtagtagaaacatggactgtaaaagatatagaagttgacccttcta
atttaggtcttaaaggttctccaactagtgtatttaaatcatttacaaaatcag
ttaaaccagctggtacaatatacaatgaagatgcgaaaacatcagctggaatta
tcatagataaattaaaagagaagtatatcatataataagaaggagatatacata
tgggtaacgttttagtagtaatagaacaaagagaaaatgtaattcaaactgttt
ctttagaattactaggaaaggctacagaaatagcaaaagattatgatacaaaag
tttctgcattacttttaggtagtaaggtagaaggtttaatagatacattagcac
actatggtcagatgaggtaatagtagtagatgatgaagctttagcagtgtata
caactgaaccatatacaaaagcagcttatgaagcaataaaaagcagctgaccta
tagttgtattatttggtgcaacttcaataggtagagatttagcgcctagagttt
ctgctagaatacatacaggtcttactgctgactgtacaggtcttgcagtagctg
aagatacaaaattattattaatgacaagacctgcctttggtggaaatataatgg
caacaatagtttgtaaagatttcagacctcaaatgtctacagttagaccaggg
ttatgaagaaaaatgaacctgatgaaactaaagaagctgtaattaaccgtttca
aggtagaatttaatgatgctgataaattagttcaagttgtacaagtaataaaag
aagctaaaaaacaagttaaaatagaagatgctaagatattagtttctgctggac
gtggaatgggtggaaaagaaaacttagacatactttatgaattagctgaaatta
taggtggagaagtttctggttctcgtgccactatagatgcaggttggttagata
aagcaagacaagttggtcaaactggtaaaactgtaagaccagacctttatatag
catgtggtatatctggagcaatacaacatatagctggtatggaagatgctgagt
ttatagttgctataaataaaaatccagaagctccaatatttaaatatgctgatg
ttggtatagttggagatgttcataaagtgcttccagaacttatcagtcagttaa
gtgttgcaaagaaaaaggtgaagttttagctaactaataagaaggagatatac
atatgagagaagtagtaattgccagtgcagctagaacagcagtaggaagttttg
gaggagcatttaaatcagtttcagcggtagagttaggggtaacagcgctaaag
aagctataaaaagagctaacataactccagatatgatagatgaatctcttttag
ggggagtacttacagcaggtcttggacaaaatatagcaagacaaatagcattag
gagcaggaatccagtagaaaaaccagctatgactataaatatagtttgtggtt
ctggattaagatctgtttcaatggcatctcaacttatagcattaggtgatgctg
atataatgttagttggtggagctgaaaacatgagtatgtctccttatttagtac
caagtgcgagatatggtgcaagaatgggtgatgctgcttttgttgattcaatga
taaaagatggattatcagacatatttaataactatcacatgggtattactgctg
aaaacatagcagagcaatggaatataactagagaagaacaagatgaattagctc
ttgcaagtcaaaataaagctgaaaaagctcaagctgaaggaaaatttgatgaag
aaatagttcctgttgttataaaaggaagaaaaggtgacactgtagtagataaag
atgaatatattaagcctggcactacaatggagaaacttgctaagttaagacctg
catttaaaaaagatggaacagttactgctggtaatgcatcaggaataaatgatg
gtgctgctatgttagtagtaatggctaaagaaaaagctgaagaactaggaatag
agcctcttgcaactatagtttcttatggaacagctggtgttgaccctaaaataa
tgggatatggaccagttccagcaactaaaaaagctttagaagctgctaatatga
ctattgaagatatagatttagttgaagctaatgaggcatttgctgcccaatctg
tagctgtaataagagacttaaatatagatatgaataaagttaatgttaatggtg
gagcaatagctataggacatccaataggatgctcaggagcaagaatacttacta
cacttttatatgaaatgaagagaagagatgctaaaactggtctttgctcactttt
gtataggcgttggaatgggaactactttaatagttaagagatagtaagaaggag
atatacatatgaaattagctgtaatagtagtggaactatgggaagtggtattg
tacaaacttttgcaagtgtgtggacatgatgtatgtttaaagagtagaactcaag
gtgctatagataaatgtttagctttattagataaaaaatttaactaagttagtta
ctaagggaaaatggatgaagctacaaaagcagaaatattaagtcatgttagtt
caactactaattatgaagatttaaaagatatggatttaataatagaagcatctg
tagaagacatgaatataaagaaagatgtttttcaagttactagatgaattatgta
aagaagatactatcttggcaacaaatacttcatcattatctataacagaaatag
cttcttctactaagcgcccagataaagttataggaatgcatttctttaatccag
ttcctatgatgaaattagttgaagttataagtggtcagttaacatcaaaagtta
cttttgatacagtatttgaattatctaagagtatcaataaaagtaccagtagatg
tatctgaatctcctggatttgtagtaaatagaatacttatacctatgataaatg
aagctgttggtatatatgcagatggtgttgcaagtaaagaagaaatagatgaag
ctatgaaattaggagcaaaaccatccaatgggaccactagcattaggtgatttaa
tcggattagatgttgttttagctataatgaacgttttatatactgaatttggag
atactaaatatagacctcatccacttttagctaaaatggttagagctaatcaat
taggaagaaaaactaagataggattctatgattataatatttaaaaaagaaggag
atatacatatgagtacaagtgatgttaaagtttatgagaatgtagctgttgaag
tagatggaaatatatgtacagtgaaaatgaatagacctaaagcccttaatgcaa |

TABLE 35 -continued

ROS regulated constructs, OxyR construct, Tet-regulated constructs

| Description | Sequence |
|---|---|
| | taaattcaaagactttagaagaactttatgaagtatttgtagatattaataatg<br>atgaaactattgatgttgtaatattgacaggggaaggaaaggcatttgtagctg<br>gagcagatattgcatacatgaaagatttagatgctgtagctgctaaagatttta<br>gtatcttaggagcaaaagcttttggagaaatagaaaatagtaaaaaagtagtga<br>tagctgctgtaaacggatttgctttaggtggaggatgtgaacttgcaatggcat<br>gtgatataagaattgcatctgctaaagctaaatttggtcagccagaagtaactc<br>ttggaataactccaggatatggaggaactcaaaggcttacaagattggttggaa<br>tggcaaaagcaaaagaattaatctttacaggtcaagttataaaagctgatgaag<br>ctgaaaaaatagggctagtaaatagagtcgttgagccagacattttaatagaag<br>aagttgagaaattagctaagataatagctaaaaatgctcagcttgcagttagat<br>actctaaagaagcaatacaacttggtgctcaaactgatataaatactggaatag<br>atatagaatctaatttatttggtctttgtttttcaactaaagaccaaaaagaag<br>gaatgtcagctttcgttgaaaagagagaagctaactttataaaagggtaataag<br>aaggagatatacatatgagaagttttgaagaagtaattaagtttgcaaaagaaa<br>gaggacctaaaactatatcagtagcatgttgccaagataaagaagttttaatgg<br>cagttgaaatggctagaaaagaaaaaatagcaaatgccattttagtaggagata<br>tagaaaagactaaagaaattgcaaaaagcatagacatggatatcgaaaattatg<br>aactgatagatataaaagatttagcagaagcatctctaaaatctgttgaattag<br>tttcacaaggaaaagccgacatggtaatgaaaggcttagtagacacatcaataa<br>tactaaaagcagttttaaataaagaagtaggtcttagaactggaaatgtattaa<br>gtcacgtagcagtatttgatgtagagggatatgatagattattttcgtaactg<br>acgcagctatgaacttagctcctgatacaaatactaaaaagcaaatcatagaaa<br>atgcttgcacagtagcacattcattagatataagtgaaccaaaagttgctgcaa<br>tatgcgcaaaagaaaaagtaaatccaaaaatgaaagatacagttgaagctaaag<br>aactagaagaaatgtatgaaagaggagaaatcaaaggttgtatggttggtgggc<br>cttttgcaattgataatgcagtatctttagaagcagctaaacataaaggtataa<br>atcatcctgtagcaggacgagctgatatattattagcccccagatattgaaggtg<br>gtaacatattatataaagctttggtattcttctcaaaatcaaaaaatgcaggag<br>ttatagttggggctaaagcaccaataatattaacttctagagcagacagtgaag<br>aaaactaaactaaactcaatagctttaggtgttttaatggcagcaaaggcataat<br>aagaaggagatatacatatgagcaaaatatttaaaatcttaacaataaatcctg<br>gttcgacatcaactaaaatagctgtatttgataatgaggatttagtatttgaaa<br>aaactttaagacattcttcagaagaaataggaaaatatgagaaggtgtctgacc<br>aatttgaatttcgtaaacaagtaatagaagaagctctaaaagaaggtggagtaa<br>aaacatctgaattagatgctgtagtaggtagaggaggacttcttaaacctataa<br>aaggtggtacttattcagtaagtgctgctatgattgaagatttaaaagtgggag<br>ttttaggagaacacgcttcaaacctaggtggaataatagcaaaacaaataggtg<br>aagaagtaaatgttccttcatacatagtagaccctgttgttgtagatgaattag<br>aagatgttgctagaatttctggtatgcctgaaataagtagagcaagtgtagtac<br>atgctttaaatcaaaaggcaatagcaagaagatatgctagagaaataaacaaga<br>aatatgaagatataaatcttatagttgcacacatgggtggaggagtttctgttg<br>gagctcataaaaatggtaaaatagtagatgttgcaaacgcattagatggagaag<br>gaccttttctctccagaaagaagtggtggactaccagtaggtgcattagtaaaa<br>tgtgctttagtggaaaatatactcaagatgaaattaaaaagaaaataaaaggta<br>atggcggactagttgcatacttaaacactaatgatgctagagaagttgaagaaa<br>gaattgaagctggtgatgaaaaagctaaattagtatatgaagctatggcatatc<br>aaatctctaaagaaataggagctagtgctgcagttcttaagggagatgtaaaag<br>caatattattaactggtggaatcgcatattcaaaaatgtttacagaaatgattg<br>cagatagagttaaatttatagcagatgtaaaagtttatccaggtgaagatgaaa<br>tgattgcattagctcaaggtggacttagagttttaactggtgaagaagaggctc<br>aagtttatgataactaataa |
| Nucleotide<br>sequences of<br>pLogic046-<br>oxyS-butyrate<br>construct (SEQ<br>ID NO: 203) | ctcgagttcattatccatcctccatcgccacgatagttcatggcgataggtaga<br>atagcaatgaacgattatccctatcaagcattctgactgataattgctcacacg<br>aattcattaaagaggagaaaggtaccatgatcgtaaaacctatggtacgcaaca<br>atatctgcctgaacgcccatcctcagggctgcaagaagggagtggaagatcaga<br>ttgaatataccaagaaacgcattaccgcagaagtcaaagctggcgcaaaagctc<br>caaaaaacgttctggtgcttggctgctcaaatggttacggcctggcgagccgca<br>ttactgctgcgttcggatacggggctgcgaccatcggcgtgtccttgaaaaag<br>cgggttcagaaaccaaatatggtacaccgggatggtacaataatttggcatttg<br>atgaagcggcaaaacgcgagggtctttatagcgtgacgatcgacggcgatgcgt<br>tttcagacgagatcaaggcccaggtaattgaggaagccaaaaaaaaaggtatca<br>aatttgatctgatcgtatacagcttggccagcccagtacgtactgatcctgata<br>caggtatcatgcacaaaagcgttttgaaacccttgggaaaaacgttcacaggca<br>aaacagtagatccgtttactggcgagctgaaggaaatctccgcggaaccagcaa<br>atgacgaggaagcagccgccactgttaaagttatgggggggtgaagattgggaac<br>gttggattaagcagctgtcgaaggaaggcctcttagaagaaggctgtattacct<br>tggcctatagttatattggccctgaagctacccaagctttgtaccgtaaaggca<br>caatcggcaaggccaaagaacacctggaggccacagcacaccgtctcaacaaag<br>agaacccgtcaatccgtgccttcgtgagcgtgaataaaggcctggtaacccgcg<br>caagcgccgtaatcccggtaatccctctgtatctcgccagcttgttcaaagtaa<br>tgaaagagaagggcaatcatgaaggttgtattgaacagatcacgcgtctgtacg<br>ccgagcgcctgtaccgtaaagatggtacaattccagttgatgaggaaaatcgca<br>ttcgcattgatgattgggagttagaagaagacgtccagaaagcggtatccgcgt<br>tgatggagaaagtcacgggtgaaaacgcagaatctctcactgacttagcggggt<br>accgccatgatttcttagctagtaacggctttgatgtagaaggtattaattatg |

TABLE 35 -continued

ROS regulated constructs, OxyR construct, Tet-regulated constructs

| Description | Sequence |
|---|---|
| | aagcggaagttgaacgcttcgaccgtatctgataagaaggagatatacatatga
gagaagtagtaattgccagtgcagctagaacagcagtaggaagttttggaggag
catttaaatcagtttcagcggtagagttaggggtaacagcagctaaagaagcta
taaaaagagctaacataactccagatatgatagatgaatctcttttaggggag
tacttacagcaggtcttggacaaaatatagcaagacaaatagcattaggagcag
gaataccagtagaaaaaccagctatgactataaatatagtttgtggttctggat
taagatctgtttcaatggcatctcaacttatagcattaggtgatgctgatataa
tgttagttggtggagctgaaaacatgagtatgtctccttatttagtaccaagtg
cgagatatggtgcaagaatgggtgatgctgcttttgttgattcaatgataaaag
atggattatcagacatatttaataactatcacatgggtattactgctgaaaaca
tagcagagcaatggaatataactagagaagaacaagatgaattagctcttgcaa
gtcaaaataaagctgaaaaagctcaagctgaaggaaaatttgatgaagaaatag
ttcctgttgttataaaaggaagaaaaggtgacactgtagtagataaagatgaat
atattaagcctggcactacaatggagaaacttgctaagttaagacctgcattta
aaaagatggaacagttactgctggtaatgcatcaggaataaatgatggtgctg
ctatgttagtagtaatggctaaagaaaaagctgaagaactaggaatagagcctc
ttgcaactatagtttcttatggaacagctggtgttgaccctaaaataatgggat
atggaccagttccagcaactaaaaaagctttagaagctgctaatatgactattg
aagatatagatttagttgaagctaatgaggcatttgctgcccaatctgtagctg
taataagagacttaaatatagatatgaataaagttaatgttaatggtggagcaa
tagctataggacatccaataggatgctcaggagcaagaatacttactacactt
tatatgaaatgaagagaagagatgctaaaactggtcttgctacactttgtatag
gcggtggaatgggaactactttaatagttaagagatagtaagaaggagatatac
atatgaaattagctgtaataggtagtggaactatgggaagtggtattgtacaaa
cttttgcaagttgtggacatgatgtatgtttaaagagtagaactcaaggtgcta
tagataaatgtttagctttattagataaaaatttaactaagttagttactaagg
gaaaaatggatgaagctacaaaagcagaaatattaagtcatgttagttcaacta
ctaattatgaagatttaaaagatatggatttaataatagaagcatctgtagaag
acatgaatataaagaaagatgttttcaagttactagatgaattatgtaaagaag
atactatcttggcaacaaatacttcatcattatctataacagaaatagcttctt
ctactaagcgcccagataaagttataggaatgcatttctttaatccagttccta
tgatgaaattagttgaagttataagtggtcagttaacatcaaaagttactttg
atacagtatttgaattatctaagagtatcaataaagtaccagtagatgtatctg
aatctcctggatttgtagtaaatagaatacttatacctatgataaatgaagctg
ttggtatatatgcagatggtgttgcaagtaaagaagaaatagatgaagctatga
aattaggagcaaaccatccaatgggaccactagcattaggtgatttaatcggat
tagatgttgttttagctataatgaacgttttatatactgaatttggagatacta
aatatagacctcatccacttttagctaaaatggttagagctaatcaattaggaa
gaaaaactaagataggattctatgattataataaataataagaaggagatatac
atatgagtacaagtgatgttaaagtttatgagaatgtagctgttgaagtagatg
gaaatatatgtacagtgaaaatgaatagacctaaagcccttaatgcaataaatt
caaagacttagaagaactttatgaagtatttgtagatattaataatgatgaaa
ctattgatgttgtaatattgacaggggaaggaaaggcatttgtagctggagcag
atattgcatacatgaaagatttagatgctgtagctgctaaagattttagtatct
taggagcaaaagcttttggagaaatagaaatagtaaaaaagtagtgatagctg
ctgtaaacggatttgctttaggtgggagatgtgaacttgcaatggcatgtgata
taagaattgcatctgctaaagctaaatttggtcagccagaagtaactcttggaa
taactccaggatatggaggaactcaaaggcttacaagattggttggaatggcaa
aagcaaaagaattaatctttacaggtcaagttataaaagctgatgaagctgaaa
aaatagggctagtaaatagagtcgttgagccagacattttaatagaagaagttg
agaaattagctaagataatagctaaaaatgctcagcttcagttagatactcta
aagaagcaatacaacttggtgctcaaactgatataaatactggaatagatatag
aatctaatttatttggtctttgttttttcaactaaagaccaaaaagaaggaatgt
cagctttcgttgaaaagagagaagctaactttataaaagggtaataagaaggag
atatacatatgagaagttttgaagaagtaattaagtttgcaaaagaaagaggac
ctaaaactatatcagtagcatgttgccaagataaagaagttttaatggcagttg
aaatggctagaaaagaaaaatagcaaatgccattttagtaggagatatagaaa
agactaaagaaattgcaaaaagcatagacatggatatcgaaaattatgaactga
tagatataaaagatttagcagaagcatctctaaaatctgttgaattagtttcac
aaggaaaagccgacatggtaatgaaaggcttagtagacacatcaataatactaa
aagcagttttaaataaagaagtaggtcttagaactggaaatgtattaagtcacg
tagcagtatttgatgtagagggatatgatagattattttcgtaactgacgcag
ctatgaacttagctcctgatacaaatactaaaaagcaaatcatagaaaatgctt
gcacagtagcacattcattagatataagtgaaccaaaagttgctgcaatatgcg
caaaagaaaaagtaaatccaaaaatgaaagatacagttgaagctaaagaactag
aagaaatgtatgaaagaggagaaatcaaaggttgtatggttggtgggcctttg
caattgataatgcagtatctttagaagcagctaaacataaagtataaatcatc
ctgtagcaggacgagctgatatattattagccccagatattgaaggtggtaaca
tattatataaagctttggtattcttctcaaaatcaaaaaatgcaggagttatag
ttggggctaaagcaccaataatattaacttctagagcagacagtgaagaaacta
aactaaaactcaatagcttaggtgttttaatggcagcaaaggcataataagaag
gagatatacatatgagcaaaatatttaaaatcttaacaataaatcctggttcga
catcaactaaaatagctgtatttgataatgaggatttagtatttgaaaaaactt
taagacattcttcagaagaaataggaaaatatgagaaggtgtctgaccaatttg
aatttcgtaaacaagtaatagaagaagctctaaaagaaggtggagtaaaaacat
ctgaattagatgctgtagtaggtagaggaggacttcttaaacctataaaaggtg |

TABLE 35 -continued

ROS regulated constructs, OxyR construct, Tet-regulated constructs

| Description | Sequence |
|---|---|
| | gtacttattcagtaagtgctgctatgattgaagatttaaaagtgggagttttag<br>gagaacacgcttcaaacctaggtggaataatagcaaaacaaataggtgaagaag<br>taaatgttccttcatacatagtagaccctgttgttgtagatgaattagaagatg<br>ttgctagaatttctggtatgcctgaaataagtagagcaagtgtagtacatgctt<br>taaatcaaaaggcaatagcaagaagatatgctagagaaataaacaagaaatatg<br>aagatataaatcttatagttgcacacatgggtggaggagtttctgttggagctc<br>ataaaaatggtaaaatagtagatgttgcaaacgcattagatggagaaggacctt<br>tctctccagaaagaagtggtggactaccagtaggtgcattagtaaaaatgtgct<br>ttagtggaaaatatactcaagatgaaattaaaaagaaaataaaaggtaatggcg<br>gactagttgcatacttaaacactaatgatgctagagaagttgaagaaagaattg<br>aagctggtgatgaaaaagctaaattagtatatgaagctatggcatatcaaatct<br>ctaaagaaataggagctagtgctgcagttcttaagggagatgtaaaagcaatat<br>tattaactggtggaatcgcatattcaaaaatgtttacagaaatgattgcagata<br>gagttaaatttatagcagatgtaaaagtttatccaggtgaagatgaaatgattg<br>cattagctcaaggtggacttagagttttaactggtgaagaagaggctcaagttt<br>atgataactaataa |
| Nucleotide<br>sequences of<br>pZA22-oxyR<br>construct (SEQ<br>ID NO: 204) | ctcgagatgctagcaattgtgagcggataacaattgacattgtgagcggataac<br>aagatactgagcacatcagcaggacgcactgaccttaattaaaagaattcatta<br>aagaggagaaaggtaccatgaatattcgtgatcttgagtacctggtggcattgg<br>ctgaacaccgccattttcggcgtgcggcagattcctgccacgttagccagccga<br>cgcttagcgggcaaattcgtaagctggaagatgagctgggcgtgatgttgctgg<br>agcggaccagccgtaaagtgttgttcacccaggcgggaatgctgctggtggatc<br>aggcgcgtaccgtgctgcgtgaggtgaaagtccttaaagagatggcaagccagc<br>agggcgagacgatgtccggaccgctgcacattggtttgattcccacagttggac<br>cgtacctgctaccgcatattatccctatgctgcaccagaccttccaaagctgg<br>aaatgtatctgcatgaagcacagacccaccagttactggcgcaactggacagcg<br>gcaaactcgattgcgtgatcctcgcgctggtgaaagagagcgaagcattcattg<br>aagtgccgttgtttgatgagccaatgttgctggctatctatgaagatcacccgt<br>gggcgaaccgcgaatgcgtaccgatggcgatctggcagggaaaaactgctga<br>tgctggaagatggtcactgtttgcgcgatcaggcaatgggtttctgttttgaag<br>ccggggcggatgaagatacacacttccgcgcgaccagcctggaaactctgcgca<br>acatggtggcggcaggtagcgggatcactttactgccagcgctggctgtgccgc<br>cggagcgcaaacgcgatggggttgtttatctgccgtgcattaagccggaaccac<br>gccgcactattggcctggtttatcgtcctggctcaccgctgcgcagccgctatg<br>agcagctggcagaggccatccgcgcaagaatggatggccatttcgataaagttt<br>aaaacaggcggtttaaggatcccatggtacgcgtgctagaggcatcaaataaa<br>acgaaaggctcagtcgaaagactgggccttcgttttatctgttgtttgtcggt<br>gaacgctctcctgagtaggacaaatccgccgccctagacctaggggatatattc<br>cgcttcctcgctcactgactcgctacgctcggtcgttcgactgcggcgagcgga<br>aatgcttacgaacggggcggagatttcctggaagatgccaggaagatacttaa<br>cagggaagtgagagggccgcggcaaagccgtttttccataggctccgccccct<br>gacaagcatcacgaaatctgacgctcaaatcagtggtggcgaaacccgacagga<br>ctataaagataccaggcgtttccccctggcggctccctcgtgcgctctcctgtt<br>cctgcctttcggtttaccggtgtcattccgctgttatggccgcgtttgtctcat<br>tccacgcctgacactcagttccgggtaggcagttcgctccaagctggactgtat<br>gcacgaaccccccgttcagtccgaccgctgcgccttatccggtaactatcgtct<br>tgagtccaacccggaaagacatgcaaaagcaccactggcagcagccactggtaa<br>ttgatttagaggagttagtcttgaagtcatgcgccggttaaggctaaactgaaa<br>ggacaagttttggtgactgcgctcctccaagccagttacctcggttcaaagagt<br>tggtagctcagagaaccttcgaaaaaccgccctgcaaggcggttttttcgtttt<br>cagagcaagagattacgcgcagaccaaaacgatctcaagaagatcatcttatta<br>atcagataaaatatttctagatttcagtgcaatttatctcttcaaatgtagcac<br>ctgaagtcagccccatacgatataagttgttactagtgcttggattctcaccaa<br>taaaaaacgcccggcggcaaccgagcgttctgaacaaatccagatggagttctg<br>aggtcattactggatctatcaacaggagtccaagcgagctctcgaacccagag<br>tcccgctcagaagaactcgtcaagaaggcgatagaaggcgatgcgctgcgaatc<br>gggagcggcgataccgtaaagcacgaggaagcggtcagcccattcgccgccaag<br>ctcttcagcaatatcacgggtagcaaacgctatgtcctgatagcggtccgccac<br>acccagccggccacagtcgatgaatccagaaaagcggccattttccaccatgat<br>attcggcaagcaggcatcgccatgggtcacgacgagatcctcgccgtcgggcat<br>gcgcgccttgagcctggcgaacagttcggctggcgcgagcccctgatgctcttc<br>gtccagatcatcctgatcgacaagaccggcttccatccgagtacgtgctcgctc<br>gatgcgatgtttcgcttggtggtcgaatgggcaggtagccggatcaagcgtatg<br>cagccgccgcattgcatcagccatgatggatactttctcggcaggagcaaggtg<br>agatgacaggagatcctgccccggcacttcgcccaatagcagccagtcccttcc<br>cgcttcagtgacaacgtcgagcacagctgcgcaaggaacgcccgtcgtggccag<br>ccacgatagccgcgctgcctcgtcctgcagttcattcagggcaccggacaggtc<br>ggtcttgacaaaaagaaccgggcgcccctgcgctgacagccggaacacggcggc<br>atcagagcagccgattgtctgttgtgcccagtcatagccgaatagcctctccac<br>ccaagcggccggagaacctgcgtgcaatccatcttgttcaatcatgcgaaacga<br>tcctcatcctgtctcttgatcagatcttgatcccctgcgccatcagatccttgg<br>cggcaagaaagccatccagtttactttgcagggcttcccaaccttaccagaggg<br>cgccccagctggcaattccgacgtctaagaaaccattattatcatgacattaac<br>ctataaaaataggcgtatcacgaggccctttcgtcttcac |

TABLE 35 -continued

ROS regulated constructs, OxyR construct, Tet-regulated constructs

| Description | Sequence |
|---|---|
| Nucleotide sequences of pLogic031-tet-butyrate construct (SEQ ID NO: 205) The sequence encoding TetR is underlined, and the overlapping tetR/tetA promoters are boxed. | gtaaaacgacggccagtgaattcgttaagacccactttcacatttaagttgttt<br>ttctaatccgcatatgatcaattcaaggccgaataagaaggctggctctgcacc<br>ttggtgatcaaataattcgatagcttgtcgtaataatggcggcatactatcagt<br>agtaggtgtttcccttcttctttagcgacttgatgctcttgatcttccaatac<br>gcaacctaaagtaaaatgccccacgcgctgagtgcatataatgcattctctag<br>tgaaaaaccttgttggcataaaaaggctaattgattttcgagagtttcatactg<br>ttttctgtaggccgtgtacctaaatgtacttttgctccatcgcgatgacttag<br>taaagcacatctaaaacttttagcgttattacgtaaaaaatcttgccagctttc<br>ccccttctaaagggcaaaagtgagtatggtgcctatctaacatctcaatggctaa<br>ggcgtcgagcaaagcccgcttatttttttacatgccaatacaatgtaggctgctc<br>tacacctagcttctgggcgagtttacgggttgttaaaccttcgattccgacctc<br>attaagcagctctaatgcgctgttaatcactttactttatctaatctagacat<br>cattaattcctaattttttgtt gacactctatcattgatagagttatttttaccac<br>tccctatcagtgatagagaa aagtgaactctagaaataattttgtttaactta<br>agaaggagatatacatatggatttaaattctaaaaaatatcagatgcttaaaga<br>gctatatgtaagcttcgctgaaaatgaagttaaaccttagcaacagaacttga<br>tgaagaagaaagatttccttatgaaacagtggaaaaaatggcaaaagcaggaat<br>gatgggtataccatatccaaaagaatatggtggagaaggtggagacactgtagg<br>atatataatggcagttgaagaattgtctagagtttgtggtactacaggagttat<br>attatcagctcatacatctcttggctcatggcctatatatcaatatggtaatga<br>agaacaaaaacaaaaattcttaagcacctagcaagtggagaaaaattaggagc<br>atttggtcttactgagcctaatgctggtacagatgcgtctggccaacaaacaac<br>tgctgtttagacggggatgaatacatacttaatggctcaaaaatatttataac<br>aaacgcaatagctggtgacatatatgtagtaatggcaatgactgataaatctaa<br>ggggaacaaaggaatatcagcatttatagttgaaaaaggaactcctgggtttag<br>ctttggagttaaagaaaagaaaatgggtataagaggttcagctacgagtgaatt<br>aatatttgaggattgcagaatacctaaagaaaatttacttggaaaagaaggtca<br>aggatttaagatagcaatgtctactcttgatggtggtagaattggtatagctgc<br>acaagcttaggtttagcacaaggtgctcttgatgaaactgttaaatatgtaaa<br>agaaagagtacaatttggtagaccattatcaaaattccaaaatacacaattcca<br>attagctgatatggaagttaaggtacaagcggctagacaccttgtatatcaagc<br>agctataaataaagacttaggaaaaccttatggagtagaagcagcaatggcaaa<br>attatttgcagctgaaacagctatggaagttactacaaaagctgtacaacttca<br>tggaggatatggatacactcgtgactatccagtagaaagaatgatgagagatgc<br>taagataactgaaatatatgaaggaactagtgaagttcaaagaatggttatttc<br>aggaaaactattaaaatagtaagaaggagatatacatatggaggaaggattat<br>gaatatagtcgtttgtataaaacaagttccagatacaacagaagttaaactaga<br>tcctaatacaggtactttaattagagatggagtaccaagtataataaaaccctga<br>tgataaagcaggtttagaagaagctataaaattaaaagaagaaatgggtgctca<br>tgtaactgttataacaatgggaccttcctcaagcagatatggctttaaagaagc<br>tttagcaatgggtgcagatagaggtatattattaacagatagagcatttgcggg<br>tgctgatacttgggcaacttcatcagcattagcaggagcattaaaaaatataga<br>ttttgatattataatagctggaagacaggcgatagatggagatactgcacaagt<br>tggacctcaaatagctgaacatttaaatcttccatcaataacatatgctgaaga<br>aataaaaactgaaggtgaatatgtattagtaaaaagacaatttgaagattgttg<br>ccatgacttaaaagttaaaatgccatgccttataacaactcttaaagatatgaa<br>cacaccaagatacatgaaagttggaagaatatatgatgcttcgaaaatgatgt<br>agtagaaacatggactgtaaaagatatagaagttgacccttctaatttaggtct<br>taaaggttctccaactagtgtatttaaatcatttacaaaatcagttaaaccagc<br>tggtacaatatacaatgaagatgcgaaaacatcagctggaattatcatagataa<br>attaaaagagaagtatatcatataataagaaggagatatacatatgggtaacgt<br>tttagtagtaatagaacaaagagaaaatgtaattcaaactgtttctttagaatt<br>actaggaaaggctacagaaatagcaaaagattatgatacaaaagtttctgcatt<br>acttttaggtagtaaggtagaaggtttaatagatacattagcacactatggtgc<br>agatgaggtaatagtagtagatgatgaagctttagcagtgtatacaactgaacc<br>atatacaaaagcagcttatgaagcaataaaagcagctgaccctatagttgtatt<br>atttggtgcaacttcaataggtagagatttagcgcctagagtttctgctagaat<br>acatacaggtctactgctgactgtacaggtcttgcagtagctgaagatacaaa<br>attattattaatgacaagacctgcctttggtggaaatataatggcaacaatagt<br>ttgtaaagatttcagacctcaaatgtctacagttagaccaggggttatgaagaa<br>aaatgaacctgatgaaactaaagaagctgtaattaaccgtttcaaggtagaatt<br>taatgatgctgataaattagttcaagttgtacaagtaataaaagaagctaaaaa<br>acaagttaaaatagaagatgctaagatattagtttctgctggacgtggaatggg<br>tggaaaagaaaacttagacatactttatgaattagctgaaatttataggtggaga<br>agtttctggttctcgtgccactatagatgcaggttggttagataaagcaagaca<br>agttggtcaaactggtaaaactgtaagaccagacctttatatagcatgtggtat<br>atctggagcaatacaacatagctggtatggaagatgctgagtttatagttgc<br>tataaataaaaatccagaagctccaatatttaaatatgctgatgttggtatagt<br>tggagatgttcataaagtgcttccagaacttatcagtcagttaagtgttgcaaa<br>agaaaaaggtgaagttttagctaactaataagaaggagatatacatatggagga<br>agtagtaattgccagtgcagctagaacagcagtaggaagttttggaggagcatt<br>taaatcagtttcagcggtagagttaggggtaacagcagctaaagaagctataaa<br>aagagctaacataactccagatatgatagatgaatctcttttaggggagtact<br>tacagcaggtcttggacaaaatatagcaagacaaatagcattaggagcaggaat<br>accagtagaaaaaccagctatgactataaatatagtttgtggttctggattaag |

TABLE 35 -continued

ROS regulated constructs, OxyR construct, Tet-regulated constructs

| Description | Sequence |
|---|---|
| | atctgtttcaatggcatctcaacttatagcattaggtgatgctgatataatgtt
agttggtggagctgaaaacatgagtatgtctccttatttagtaccaagtgcgag
atatggtgcaagaatgggtgatgctgcttttgttgattcaatgataaaagatgg
attatcagacatatttaataactatcacatgggtattactgctgaaaacatagc
agagcaatggaatataactagagaagaacaagatgaattagctcttgcaagtca
aaatgcaaaaagctcaagctgaaggaaaatttgatgaagaaatagttcc
tgttgttataaaaggaagaaaaggtgacactgtagtagataaagatgaatatat
taagcctggcactacaatggagaaacttgctaagttaagacctgcatttaaaaa
agatggaacagttactgctggtaatgcatcaggaataaatgatggtgctgctat
gttagtagtaatggctaaagaaaaagctgaagaactaggaatagagcctcttgc
aactatagtttcttatggaacagctggtgttgacccaaaataatgggatatgg
accagttccagcaactaaaaaagctttagaagctgctaatatgactattgaaga
tatagatttagttgaagctaatgaggcatttgctgcccaatctgtagctgtaat
aagagacttaaatatagatatgaataaagttaatgttaatggtggagcaatagc
tataggacatccaataggatgctcaggagcaagaatacttactacacttttata
tgaaatgaagagaagagatgctaaaactggtcttgctacactttgtataggcgg
tggaatgggaactactttaatagttaagagatagtaagaaggagatatacatat
gaaattagctgtaataggtagtggaactatgggaagtggtattgtacaaacttt
tgcaagttgtggacatgatgtatgtttaaagagtagaactcaaggtgctataga
taaatgtttagctttattagataaaaatttaactaagttagttactaagggaaa
aatggatgaagctacaaaagcagaaatattaagtcatgttagttcaactactaa
ttatgaagatttaaaagatatggatttaataatagaagcatctgtagaagacat
gaatataaagaaagatgttttcaagttactagatgaattatgtaaagaagatac
tatcttggcaacaaatacttcatcattatctataacagaaatagcttcttctac
taagcgcccagataaagttataggaatgcatttctttaatccagttcctatgat
gaaattagttgaagttataagtggtcagttaacatcaaaagttacttttgatac
agtatttgaattatctaagagtatcaataaagtaccagtagatgtatctgaatc
tcctggatttgtagtaaatagaatacttatacctatgataaatgaagctgttgg
tatatatgcagatggtgttgcaagtaaagaagaaatagatgaagctatgaaatt
aggagcaaaccatccaatgggaccactagtaggtgatttaatcggattaga
tgttgttttagctataatgaacgttttatatactgaatttggagatactaaata
tagacctcatccacttttagctaaaatggttagagctaatcaattaggaagaaa
aactaagataggattctatgattataataaataataagaaggagatatacatat
gagtacaagtgatgttaaagtttatgagaatgtagctgttgaagtagatggaaa
tatatgtacagtgaaaatgaatagacctaaagcccttaatgcaataaattcaaa
gactttagaagaactttatgaagtatttgtagatattaataatgatgaaactat
tgatgttgtaatattgacaggggaaggaaaggcatttgtagctggagcagatat
tgcatacatgaaagatttagatgctgtagctgctaaagattttagtatcttagg
agcaaaagcttttggagaaatagaaaatagtaaaaaagtagtgatagctgctgt
aaacggatttgctttaggtggaggatgtgaacttgcaatggcatgtgatataag
aattgcatctgctaaagctaaatttggtcagccagaagtaactcttggaataac
tccaggatatggaggaactcaaaggcttacaagattggttggaatggcaaaagc
aaaagaattaatctttacaggtcaagttataaaagctgatgaagctgaaaaaat
agggctagtaaatagagtcgttgagccagacattttaatagaagaagttgagaa
attagctaagataatagctaaaaatgctcagcttgcagttagatactctaaaga
agcaatacaacttggtgctcaaactgatataaatactggaatagatatagaatc
taatttatttggtctttgtttttcaactaaagaccaaaaagaaggaatgtcagc
tttcgttgaaaagagagaagctaactttataaaagggtaataagaaggagatat
acatatgagaagttttgaagaagtaattaagtttgcaaaagaaagaggacctaa
aactatatcagtagcatgttgccaagataaagaagtttttaatggcagttgaaat
ggctagaaaagaaaaaatagcaaatgccattttagtaggagatatagaaaagac
taaagaaattgcaaaaagcatagacatggatatcgaaaattatgaactgataga
tataaaagatttagcagaagcatctctaaaatctgttgaattagtttcacaagg
aaaagccgacatggtaatgaaaggcttagtagacacatcaataatactaaaagc
agttttaaataaagaagtaggtcttagaactggaaatgtattaagtcacgtagc
agtatttgatgtagagggatatgatagattattttttcgtaactgacgcagctat
gaacttagctcctgatacaaatactaaaaagcaaatcatagaaaatgcttgcac
agtagcacattcattagatataagtgaaccaaaagttgctgcaatatgcgcaaa
agaaaaagtaaatccaaaaatgaaagatacagttgaagctaaagaactagaaga
aatgtatgaaagaggagaaatcaaaggttgtatggttggtgggccttttgcaat
tgataatgcagtatctttagaagcagctaaacataaaggtataaatcatcctgt
agcaggacgagctgatatattattagcccccagatattgaaggtggtaacatatt
atataaagctttggtattcttctcaaaatcaaaaaatgcaggagttatagttgg
ggctaaagcaccaataatattaacttctagagcagacagtgaagaaactaaact
aaactcaatagctttaggtgttttaatggcagcaaaggcataataagaaggaga
tatacatatgagcaaaatatttaaaatcttaacaataaatcctggttcgacatc
aactaaaatagctgtatttgataatgaggatttagtatttgaaaaaactttaag
acattcttcagaagaaataggaaaatatgagaaggtgtctgaccaatttgaatt
tcgtaaacaagtaatagaagaagctctaaaagaaggtggagtaaaaacatctga
attagatgctgtagtaggtagaggaggacttcttaaacctataaaaggtggtac
ttattcagtaagtgctgctatgattgaagatttaaaagtgggagttttaggaga
acacgcttcaaacctaggtggaataatagcaaaacaaatggtgaagaagtaaa
tgttccttcatacatagtagacctgttgttgatgaattagaagatgttgc
tagaatttctggtatgcctgaaataagtgagcaagtgtagtacatgctttaaa
tcaaaaggcaatagcaagaagatatgctagagaaataaacaagaaatatgaaga
tataaatcttatagttgcacacatgggtggaggagtttctgttggagctcataa |

TABLE 35 -continued

ROS regulated constructs, OxyR construct, Tet-regulated constructs

| Description | Sequence |
|---|---|
| | aaatggtaaaatagtagatgttgcaaacgcattagatgggagaaggacctttctc<br>tccagaaagaagtggtggactaccagtaggtgcattagtaaaaatgtgctttag<br>tggaaaatatactcaagatgaaattaaaaagaaaataaaaggtaatggcggact<br>agttgcatacttaaacactaatgatgctagagaagttgaagaaagaattgaagc<br>tggtgatgaaaaagctaaattagtatatgaagctatggcatatcaaatctctaa<br>agaaataggagctagtgctgcagttcttaagggagatgtaaaagcaatattatt<br>aactggtggaatcgcatattcaaaaatgtttacagaaatgattgcagatagagt<br>taaatttatagcagatgtaaaagtttatccaggtgaagatgaaatgattgcatt<br>agctcaaggtggacttagagttttaactggtgaagaagaggctcaagtttatga<br>taactaataa |
| Nucleotide sequences of pLogic046-tet-butyrate construct (SEQ ID NO: 206) The sequence encoding TetR is <u>underlined</u>, and the overlapping tetR/tetA promoters are boxed. | gtaaaacgacggccagtgaattcg<u>ttaagacccactttcacatttaagttgttt</u><br><u>ttctaatccgcatatgatcaattcaaggccgaataagaaggctggctctgcacc</u><br><u>ttggtgatcaaataattcgatagcttgtcgtaataatggcggcatactatcagt</u><br><u>agtaggtgtttccctttcttctttagcgacttgatgctcttgatcttccaatac</u><br><u>gcaacctaaagtaaaatgccccacagcgctgagtgcatataatgcattctctag</u><br><u>tgaaaaacctttgttggcataaaaaggctaattgatttttcgagagtttcatactg</u><br><u>tttttctgtaggccgtgtacctaaatgtacttttgctccatcgcgatgacttag</u><br><u>taaagcacatctaaaacttttagcgttattacgtaaaaaatcttgccagctttc</u><br><u>cccttctaaagggcaaaagtgagtatggtgcctatctaacatctcaatggctaa</u><br><u>ggcgtcgagcaaagcccgcttattttttacatgccaatacaatgtaggctgctc</u><br><u>tacacctagcttctgggcgagtttacgggtgttaaaccttcgattccgacctc</u><br><u>attaagcagctctaatgcgctgttaatcacttttacttttatctaatctagacat</u><br>cattaattcctaattttttgtt<span style="border:1px solid">gacactctatcattgatagagttattttaccac</span><br><span style="border:1px solid">tccctatcagtgatagagaa</span>aagtgaactctagaaataattttgtttaacttta<br>agaaggagatatacatatgatcgtaaaacctatggtacgcaacaatatctgcct<br>gaacgcccatcctcagggctgcaagaagggagtggaagatcagattgaatatac<br>caagaaacgcattaccgcagaagtcaaagctggcgcaaaagctccaaaaaacgt<br>tctggtgcttggctgctcaaatggttacggcctggcgagccgcattactgctgc<br>gttcggatacggggctgcgaccatcggcgtgtcctttgaaaaagcgggttcaga<br>aaccaaatatggtacaccgggatggtacaataattttggcatttgatgaagcggc<br>aaaacgcgagggtctttatagcgtgacgatcgacggcgatgcgttttcagacga<br>gatcaaggcccaggtaattgaggaagccaaaaaaaaaggtatcaaatttgatct<br>gatcgtatacagcttggccagcccagtacgtactgatcctgatacaggtatcat<br>gcacaaaagcgttttgaaaccctttggaaaaacgttcacaggcaaaacagtaga<br>tccgtttactggcgagctgaaggaaatctccgcggaaccagcaaatgacgagga<br>agcagccgccactgttaaagttatgggggtgaagattgggaacgttggattaa<br>gcagctgtcgaaggaaggcctcttagaagaaggctgtattaccttggcctatag<br>ttatattggccctgaagctacccaagctttgtaccgtaaaggcacaatcggcaa<br>ggccaaagaacacctggaggccacagcacaccgtctcaacaaagagaacccgtc<br>aatccgtgccttcgtgagcgtgaataaaaggcctggtaacccgcgcaagcgccgt<br>aatcccggtaatccctctgtatctcgccagcttgttcaaagtaatgaaagagaa<br>gggcaatcatgaaggttgtattgaacagatcacgcgtctgtacgccgagcgcct<br>gtaccgtaaagatggtacaattccagttgatgaggaaaatcgcattcgcattga<br>tgattgggagttagaagaagacgtccagaaagcggtatccgcgttgatggagaa<br>agtcacgggtgaaaacgcagaatctctcactgacttagcgggtaccgccatga<br>tttcttagctagtaacggctttgatgtagaaggtattaattatgaagcggaagt<br>tgaacgcttcgaccgtatctgataagaaggagatatacatatgagagaagtagt<br>aattgccagtgcagctagaacagcagtaggaagttttggaggagcatttaaatc<br>agtttcagcgggtagagttaggggtaacagcagctaaagaagctataaaaagagc<br>taacataactccagatatgatagatgaatctcttttaggggggagtacttacagc<br>aggtcttggacaaaatatagcaagacaaatagcattaggagcaggaataccagt<br>agaaaaaccagctatgactataaatatagtttgtggttctggattaagatctgt<br>ttcaatggcatctcaacttatagcattaggtgatgctgatataatgttagttgg<br>tggagctgaaaacatgagtatgtctccttatttagtaccaagtgcgagatatgg<br>tgcaagaatgggtgatgctgcttttgttgattcaatgataaaagatggattatc<br>agacatatttaataactatcacatgggtattactgctgaaaacatagcagagca<br>atggaatataactagagaagaacaagatgaattagctcttgcaagtcaaaataa<br>agctgaaaaagctcaagctgaaggaaaatttgatgaagaaatagttcctgttgt<br>tataaaaggaagaaaaggtgacactgtagtagataaagatgaatatattaagcc<br>tggcactacaatggagaaacttgctaagttaagacctgcatttaaaaaagatgg<br>aacagttactgctggtaatgctcatcaggaataaaatgatggtgctgctatgttagt<br>agtaatggctaaagaaaaagctgaagaactaggaatagagcctcttgcaactat<br>agtttcttatggaacagctggtgttgaccctaaaataatgggatatggaccagt<br>tccagcaactaaaaaagctttagaagctgctaatatgactattgaagatatagA<br>tttagttgaagctaatgaggcatttgctgcccaatctgtagctgtaataagaga<br>cttaaatatagatatgaataaagttaatgttaatggtggagcaatagctatagg<br>acatccaataggatgctcaggagcaagaatacttactacactttttatatgaaat<br>gaagagaagagatgctaaaactggtcttgctacactttgtataggcggtggaat<br>gggaactactttaatagttaagagatagtaagaaggagatatacatatgaaatt<br>agctgtaataggtagtggaactatgggaagtggtattgtacaaacttttgcaag<br>ttgtggacatgatgtatgtttaaagagtagaactcaaggtgctatagataaatg<br>tttagctttattagatataaaaatttaactaagttagttactaagggaaaaatgga<br>tgaagctacaaaagcagaaatattaagtcatgttagttcaactactaattatga<br>agatttaaaagatatggattttaataatagaagcatctgtagaagacatgaatat |

TABLE 35 -continued

ROS regulated constructs, OxyR construct, Tet-regulated constructs

| Description | Sequence |
|---|---|
| | aaagaaagatgttttcaagttactagatgaattatgtaaagaagatactatctt
ggcaacaaatacttcatcattatctataacagaaatagcttcttctactaagcg
cccagataaagttataggaatgcatttctttaatccagttcctatgatgaaatt
agttgaagttataagtggtcagttaacatcaaaagttacttttgatacagtatt
tgaattatctaagagtatcaataaagtaccagtagatgtatctgaatctcctgg
atttgtagtaaatagaatacttatacctatgataaatgaagctgttggtatata
tgcagatggtgttgcaagtaaagaagaaatagatgaagctatgaaattaggagc
aaaccatccaatgggaccactagcattaggtgatttaatcggattagatgttgt
tttagctataatgaacgttttatatactgaatttggagatactaaatatagacc
tcatccacttttagctaaaatggttagagctaatcaattaggaagaaaaactaa
gataggattctatgattataataaataataagaaggagatatacatatgagtac
aagtgatgttaaagtttatgagaatgtagctgttgaagtagatggaaatatatg
tacagtgaaaatgaatagacctaaagcccttaatgcaataaattcaaagacttt
agaagaactttatgaagtatttgtagatattaataatgatgaaactattgatgt
tgtaatattgacaggggaaggaaaggcatttgtagctggagcagatattgcata
catgaaagatttagatgctgtagctgctaaagattttagtatcttaggagcaaa
agcttttggagaaatagaaaatagtaaaaaagtagtgatagctgctgtaaacgg
atttgctttaggtggaggatgtgaacttgcaatggcatgtgatataagaattgc
atctgctaaagctaaatttggtcagccagaagtaactcttggaataactccagg
atatggaggaactcaaaggcttacaagattggttggaatggcaaaagcaaaaga
attaatctttacaggtcaagttataaaagctgatgaagctgaaaaaataggggct
agtaaatagagtcgttgagccagacattttaatagaagaagttgagaaattagc
taagataatagctaaaaatgctcagcttgcagttagatactctaaagaagcaat
acaacttggtgctcaaactgatataaatactggaatagatatagaatctaattt
atttggtctttgtttttcaactaaagaccaaaaagaaggaatgtcagctttcgt
tgaaaagagagaagctaactttataaaagggtaataagaaggagatatacatat
gagaagttttgaagaagtaattaagtttgcaaaagaaagaggacctaaaactat
atcagtagcatgttgccaagataaagaagttttaatggcagttgaaatggctag
aaaagaaaaaatagcaaatgccattttagtaggagatatagaaaagactaaaga
aattgcaaaaagcatagacatggatatcgaaaattatgaactgatagatataaa
agatttagcagaagcatctctaaaatctgttgaattagtttcacaaggaaaagc
cgacatggtaatgaaaggcttagtagacacatcaataatactaaaagcagtttt
aaataaagaagtaggtcttagaactggaaatgtattaagtcacgtagcagtatt
tgatgtagagggatatgatagattattttttcgtaactgacgcagctatgaactt
agctcctgatacaaatactaaaaagcaaatcatagaaaatgcttgcacagtagc
acattcattagatataagtgaaccaaaagttgctgcaatatgcgcaaaagaaaa
agtaaatccaaaaatgaaagatacagttgaagctaaagaactagaagaaatgta
tgaaagaggagaaatcaaaggttgtatggttggtgggccttttgcaattgataa
tgcagtatctttagaagcagctaaacataaaggtataaatcatcctgtagcagg
acgagctgatatattattagccccagatattgaaggtggtaacatattatataa
agctttggtattcttctcaaaatcaaaaaatgcaggagttatagttggggctaa
agcaccaataatattaacttctagagcagacagtgaagaaactaaactaaactc
aatagctttaggtgttttaatggcagcaaaggcataataagaaggagatataca
tatgagcaaaatatttaaaatcttaacaataaatcctggttcgacatcaactaa
aatagctgtatttgataatgaggatttagtatttgaaaaaactttaagcattc
ttcagaagaaataggaaaatatgagaaggtgtctgaccaatttgaatttcgtaa
acaagtaatagaagaagctctaaaagaaggtggagtaaaaacatctgaattaga
tgctgtagtaggtagaggaggacttcttaaacctataaaaggtggtacttattc
agtaagtgctgctatgattgaagatttaaaagtgggagttttaggagaacacgc
ttcaaacctaggtggaataatagcaaaacaaataggtgaagaagtaaatgttcc
ttcatacatagtagaccctgttgttgtagatgaattagaagatgttgctagaat
ttctggtatgcctgaaataagtagagcaagtgtagtacatgctttaaatcaaaa
ggcaatagcaagaagatatgctagagaaataaacaagaaatatgaagatataaa
tcttatagttgcacacatgggtggaggagtttctgttggagctcataaaaatgg
taaaatagtagatgttgcaaacgcattagatgggagaaggacctttctctccaga
aagaagtggtggactaccagtaggtgcattagtaaaaatgtgctttagtggaaa
atatactcaagatgaaattaaaaagaaaataaaaggtaatggcggactagttgc
atacttaaacactaatgatgctagagaagttgaagaaagaattgaagctggtga
tgaaaaagctaaattagtatatgaagctatggcatatcaaatctctaaagaaat
aggagctagtgctgcagttcttaagggagatgtaaaagcaatattattaactgg
tggaatcgcatattcaaaaatgtttacagaaatgattgcagatagagttaaatt
tatagcagatgtaaaagtttatccaggtgaagatgaaatgattgcattagctca
aggtggacttagagttttaactggtgaagaagaggctcaagtttatgataacta
ataa |

In certain constructs, the butyrate gene cassette is placed under the control of a tetracycline-inducible or constitutive promoter.

In a third butyrate gene cassette, the pbt and buk genes are replaced with tesB. TesB is a thioesterase found in *E. coli* that cleaves off the butyrate from butyryl-coA, thus obviating the need for pbt-buk.

In one embodiment, the tesB cassette is placed under the control of a FNR regulatory region selected from any of the sequences in Table 6. In an alternate embodiment, the tesB cassette is placed under the control of an RNS-responsive regulatory region, e.g., norB, and the bacteria further comprises a gene encoding a corresponding RNS-responsive transcription factor, e.g., nsrR. In yet another embodiment, the tesB cassette is placed under the control of an ROS-responsive regulatory region, e.g., oxyS, and the bacteria further comprises a gene encoding a corresponding ROS-responsive transcription factor, e.g., oxyR. In certain constructs, the different described butyrate gene cassettes are each placed under the control of a tetracycline-inducible or constitutive promoter. For example, genetically engineered Nissle are generated comprising a butyrate gene cassette in which the pbt and buk genes are replaced with tesB expressed under the control of a nitric oxide-responsive regulatory element. SEQ ID NO: 207 comprises a reverse complement of the nsrR repressor gene from *Neisseria gonorrhoeae* (underlined), intergenic region containing divergent promoters controlling nsrR and the butyrogenic gene cassette and their respective RBS (bold), and the butyrate genes (ter-thiA-hbd-crt-tesB) separated by RBS.

TABLE 36

SEQ ID NO: 207

SEQ ID NO: 207
ttatt<u>atcgcaccgcaatcgggattttcgattcataaagcaggtcgtagg</u>

<u>tcggcttgttgagcaggtcttgcagcgtgaaaccgtccagatacgtgaaa</u>

<u>aacgacttcattgcaccgccgagtatgcccgtcagccggcaggacggcgt</u>

<u>aatcaggcattcgttgttcgggcccatacactcgaccagctgcatcggtt</u>

<u>cgaggtggcggacgaccgcgccgatattgatgcgttcgggcggcgcggcc</u>

<u>agcctcagcccgccgcctttcccgcgtacgctgtgcaagaacccgccttt</u>

<u>gaccagcgcggtaaccactttcatcaaatggcttttggaaatgccgtagg</u>

<u>tcgaggcgatggtggcgatattgaccagcgcgtcgtcgttgacggcggtg</u>

<u>tagatgaggacgcgcagcccgtagtcggtatgttgggtcagatacat</u>aca acctccttagtacatgcaaaattatttctagagcaacatacgagccggaa gcataaagtgtaaagcctggggtgcctaatgagttgagttgaggaattat aacaggaagaaatattcctcatacgcttgtaattcctctatggttgttga caattaatcatcggctcgtataatgtataacattcatattttgtgaattt taaactctagaaataattttgtttaactttaagaaggagatatacatatg atcgtaaaacctatggtacgcaacaatatctgcctgaacgcccatcctca gggctgcaagaagggagtggaagatcagattgaatataccaagaaacgca ttaccgcagaagtcaaagctggcgcaaaagctccaaaaaacgttctggtg cttggctgctcaaatggttacggcctggcgagccgcattactgctgcgtt cggatacggggctgcgaccatcggcgtgtcctttgaaaaagcgggttcag aaaccaaatatggtacaccgggatggtacaataatttggcatttgatgaa gcggcaaaacgcgagggtctttatagcgtgacgatcgacggcgatgcgtt ttcagacgagatcaaggcccaggtaattgaggaagccaaaaaaaaggta tcaaatttgatctgatcgtatacagcttggccagcccagtacgtactgat cctgatacaggtatcatgcacaaaagcgttttgaaaccctttggaaaaac gttcacaggcaaaacagtagatccgtttactggcgagctgaaggaaatct ccgcggaaccagcaaatgacgaggaagcagccgccactgttaaagttatg ggggtgaagattgggaacgttggattaagcagctgtcgaaggaaggcct cttagaagaaggctgtattaccttggcctatagttatattggccctgaag ctacccaagctttgtaccgtaaaggcacaatcggcaaggccaaagaacac TABLE 36-continued

SEQ ID NO: 207 ctggaggccacagcacaccgtctcaacaaagagaacccgtcaatccgtgc cttcgtgagcgtgaataaaggcctggtaacccgcgcaagcgccgtaatcc cggtaatccctctgtatctcgccagcttgttcaaagtaatgaaagagaag ggcaatcatgaaggttgtattgaacagatcacgcgtctgtacgccgagcg cctgtaccgtaaagatggtacaattccagttgatgaggaaaatcgcattc gcattgatgattgggagttagaagaagacgtccagaaagcggtatccgcg ttgatggagaaagtcacgggtgaaaacgcagaatctctcactgacttagc ggggtaccgccatgatttcttagctagtaacggctttgatgtagaaggta ttaattatgaagcggaagttgaacgcttcgaccgtatctgataagaagga gatatacatatgagagaagtagtaattgccagtgcagctagaacagcagt aggaagttttggaggagcatttaaatcagtttcagcggtagagttagggg taacagcagctaaagaagctataaaagagctaacataactccagatatg atagatgaatctcttttaggggagtacttacagcaggtcttggacaaaa tatagcaagacaaatagcattaggagcaggaataccagtagaaaaaccag ctatgactataaatatagtttgtggtctggattaagatctgtttcaatg gcatctcaacttatagcattaggtgatgctgatataatgttagttggtgg agctgaaaacatgagtatgtctccttatttagtaccaagtgcgagatatg gtgcaagaatgggtgatgctgcttttgttgattcaatgataaaagatgga ttatcagacatatttaataactatcacatgggtattactgctgaaaacat agcagagcaatggaatataactagagaagaacaagatgaattagctcttg caagtcaaaataaagctgaaaaagctcaagctgaaggaaaatttgatgaa gaaatagttcctgttgttataaaaggaagaaaaggtgacactgtagtaga taaagatgaatatattaagcctggcactacaatggagaaacttgctaagt taagacctgcatttaaaaaagatggaacagttactgctggtaatgcatca ggaataaatgatggtgctgctatgttagtagtaatggctaaagaaaaagc tgaagaactaggaatagagcctcttgcaactatagtttcttatggaacag ctggtgttgacccctaaaataatgggatatggaccagttccagcaactaaa aaagctttagaagctgctaatatgactattgaagatatagatttagttga agctaatgaggcatttgctgcccaatctgtagctgtaataagagacttaa atatagatatgaataaagttaatgttaatggtggagcaatagctataggaa catccaataggatgctcaggagcaagaatacttactacacttttatatga aatgaagagaagagatgctaaaactggtcttgctacactttgtataggcg gtggaatgggaactactttaatagttaagagatagtaagaaggagatata catatgaaattagctgtaataggtagtggaactatgggaagtggtattgt acaaacttttgcaagttgtggacatgatgtatgtttaaagagtagaactc aaggtgctatagataaatgtttagctttattagataaaaatttaactaag ttagttactaagggaaaaatggatgaagctacaaaagcagaaatattaag tcatgttagttcaactactaattatgaagatttaaaagatatggatttaa taatagaagcatctgtagaagacatgaatataaagaaagatgtttttcaag TABLE 36-continued

SEQ ID NO: 207

```
ttactagatgaattatgtaaagaagatactatcttggcaacaaatacttc
atcattatctataacagaaatagcttcttctactaagcgcccagataaag
ttataggaatgcatttctttaatccagttcctatgatgaaattagttgaa
gttataagtggtcagttaacatcaaaagttacttttgatacagtatttga
attatctaagagtatcaataaagtaccagtagatgtatctgaatctcctg
gatttgtagtaaatagaatacttatacctatgataaatgaagctgttggt
atatatgcagatggtgttgcaagtaaagaagaaatagatgaagctatgaa
attaggagcaaaccatccaatgggaccactagcattaggtgatttaatcg
gattagatgttgttttagctataatgaacgttttatatactgaatttgga
gatactaaatatagacctcatccacttttagctaaaatggttagagctaa
tcaattaggaagaaaaactaagataggattctatgattataataaataat
aagaaggagatatacatatgagtacaagtgatgttaaagtttatgagaat
gtagctgttgaagtagatggaaatatatgtacagtgaaaatgaatagacc
taaagcccttaatgcaataaattcaaagactttagaagaactttatgaag
tatttgtagatattaataatgatgaaactattgatgttgtaatattgaca
ggggaaggaaaggcatttgtagctggagcagatattgcatacatgaaaga
tttagatgctgtagctgctaaagattttagtatcttaggagcaaaagctt
ttggagaaatagaaatagtaaaaaagtagtgatagctgctgtaaacgga
tttgctttaggtggaggatgtgaacttgcaatggcatgtgatataagaat
tgcatctgctaaagctaaatttggtcagccagaagtaactcttggaataa
ctccaggatatggaggaactcaaaggcttacaagattggttggaatggca
aaagcaaaagaattaatctttacaggtcaagttataaaagctgatgaagc
tgaaaaaatagggctagtaaatagagtcgttgagccagacattttaatag
aagaagttgagaaattagctaagataatagctaaaaatgctcagcttgca
gttagatactctaaagaagcaatacaacttggtgctcaaactgatataaa
tactggaatagatatagaatctaatttatttggtctttgtttttcaacta
aagaccaaaagaaggaatgtcagctttcgttgaaaagagagaagctaac
tttataaaagggtaataagaaggagatatacatatgAGTCAGGCGCTAAA
AAATTTACTGACATTGTTAAATCTGGAAAAAATTGAGGAAGGACTCTTTC
GCGGCCAGAGTGAAGATTTAGGTTTACGCCAGGTGTTTGGCGGCCAGGTC
GTGGGTCAGGCCTTGTATGCTGCAAAAGAGACCGTCCCTGAAGAGCGGCT
GGTACATTCGTTTCACAGCTACTTTCTTCGCCCTGGCGATAGTAAGAAGC
CGATTATTTATGATGTCGAAACGCTGCGTGACGGTAACAGCTTCAGCGCC
CGCCGGGTTGCTGCTATTCAAAACGGCAAACCGATTTTTTATATGACTGC
CTCTTTCCAGGCACCAGAAGCGGGTTTCGAACATCAAAAAACAATGCCGT
CCGCGCCAGCGCCTGATGGCCTCCCTTCGGAAACGCAAATCGCCCAATCG
CTGGCGCACCTGCTGCCGCCAGTGCTGAAAGATAAATTCATCTGCGATCG
TCCGCTGGAAGTCCGTCCGGTGGAGTTTCATAACCCACTGAAAGGTCACG
TCGCAGAACCACATCGTCAGGTGTGGATCCGCGCAAATGGTAGCGTGCCG
GATGACCTGCGCGTTCATCAGTATCTGCTCGGTTACGCTTCTGATCTTAA
CTTCCTGCCGGTAGCTCTACAGCCGCACGGCATCGGTTTTCTCGAACCGG
GGATTCAGATTGCCACCATTGACCATTCCATGTGGTTCCATCGCCCGTTT
AATTTGAATGAATGGCTGCTGTATAGCGTGGAGAGCACCTCGGCGTCCAG
CGCACGTGGCTTTGTGCGCGGTGAGTTTTATACCCAAGACGGCGTACTGG
TTGCCTCGACCGTTCAGGAAGGGGTGATGCGTAATCACAATtaa
```

Example 11. Construction of Vectors for Overproducing Butyrate Using a Tet-Inducible Promoter To facilitate inducible production of butyrate in *Escherichia coli* Nissle, the eight genes of the butyrate production pathway from *Peptoclostridium difficile* (bcd, etfB, etfA, thiA, hbd, crt, bpt, and buk; NCBI), as well as transcriptional and translational elements, were synthesized (Gen, Cambridge, Mass.) and cloned into vector pBR to create pLogic. As synthesized, the genes were placed under control of a tetracycline-inducible promoter, with the tet repressor (tetR) expressed constitutively, divergent from the tet-inducible synthetic butyrate operon. For efficient translation of butyrate genes, each synthetic gene in the operon was separated by a base pair ribosome binding site derived from the T promoter.

The gene products of bcd-etfA-etfB form a complex that convert crotonyl-CoA to butyryl-CoA, and may show some dependence on oxygen as a co-oxidant. Because an effective probiotic should be able to function in an oxygen-limited environment (e.g. the mammalian gut), and because it has been shown that a single gene from *Treponema denticola* can functionally replace this three gene complex in an oxygen-independent manner (trans-enoynl-CoA reductase; ter), we created a second plasmid capable of butyrate production in *E. coli*. Inverse PCR was used to amplify the entire sequence of pLogic outside of the bcd-etfA-etfB region. The ter gene was codon optimized for *E. coli* codon usage using Integrated DNA technologies online codon optimization tool (https://www.idtdna.com/CodonOpt), synthesized (Genewiz, Cambridge, Mass.), and cloned into this inverse PCR fragment using Gibson assembly to create pLogic.

Example 12. Transforming *E. coli*

Each plasmid is transformed into *E. coli* Nissle or *E. coli* DH5a. All tubes, solutions, and cuvettes are pre-chilled to 4° C. An overnight culture of *E. coli* Nissle or *E. coli* DH5a is diluted 1:100 in 5 mL of lysogeny broth (LB) and grown until it reached an $OD_{600}$ of 0.4-0.6. The cell culture medium contains a selection marker, e.g., ampicillin, that is suitable for the plasmid. The *E. coli* cells are then centrifuged at 2,000 rpm for 5 min. at 4° C., the supernatant is removed, and the cells are resuspended in 1 mL of 4° C. water. The *E. coli* are again centrifuged at 2,000 rpm for 5 min. at 4° C., the supernatant is removed, and the cells are resuspended in 0.5 mL of 4° C. water. The *E. coli* are again centrifuged at 2,000 rpm for 5 min. at 4° C., the supernatant is removed, and the cells are finally resuspended in 0.1 mL of 4° C.

water. The electroporator is set to 2.5 kV. 0.5 µg of one of the above plasmids is added to the cells, mixed by pipetting, and pipetted into a sterile, chilled cuvette. The dry cuvette is placed into the sample chamber, and the electric pulse is applied. One mL of room-temperature SOC media is immediately added, and the mixture is transferred to a culture tube and incubated at 37° C. for 1 hr. The cells are spread out on an LB plate containing ampicillin and incubated overnight.

In alternate embodiments, the butyrate cassette can be inserted into the Nissle genome through homologous recombination (Genewiz, Cambridge, Mass.). Organization of the constructs and nucleotide sequences are provided herein. To create a vector capable of integrating the synthesized butyrate cassette construct into the chromosome, Gibson assembly was first used to add 1000 bp sequences of DNA homologous to the Nissle lacZ locus into the R6K origin plasmid pKD3. This targets DNA cloned between these homology arms to be integrated into the lacZ locus in the Nissle genome. Gibson assembly was used to clone the fragment between these arms. PCR was used to amplify the region from this plasmid containing the entire sequence of the homology arms, as well as the butyrate cassette between them. This PCR fragment was used to transform electrocompetent Nissle-pKD46, a strain that contains a temperature-sensitive plasmid encoding the lambda red recombinase genes. After transformation, cells were grown out for 2 hours before plating on chloramphenicol at 20 ug/mL at 37 degrees C. Growth at 37 degrees C. also cures the pKD46 plasmid. Transformants containing cassette were chloramphenicol resistant and lac-minus (lac-).

Example 13. Production of Butyrate in Recombinant E. coli

Production of butyrate is assessed in E. coli Nissle strains containing the butyrate cassettes described above in order to determine the effect of oxygen on butyrate production. All incubations are performed at 37° C. Cultures of E. coli strains DH5 a and Nissle transformed with the butyrate cassettes are grown overnight in LB and then diluted 1:200 into 4 mL of M9 minimal medium containing 0.5% glucose. The cells are grown with shaking (250 rpm) for 4-6 h and incubated aerobically or anaerobically in a Coy anaerobic chamber (supplying 90% N2, 5% CO2, 5% H2). One mL culture aliquots are prepared in 1.5 mL capped tubes and incubated in a stationary incubator to limit culture aeration. One tube is removed at each time point (0, 1, 2, 4, and 20 hrs) and analyzed for butyrate concentration by LC-MS to confirm that butyrate production in these recombinant strains can be achieved in a low-oxygen environment.

Example 14. Production of Butyrate in Recombinant E. coli

Production of butyrate is assessed in E. coli Nissle strains containing the butyrate cassettes described above in order to determine the effect of oxygen on butyrate production. All incubations are performed at 37° C. Cultures of E. coli strains DH5a and Nissle transformed with the butyrate cassettes are grown overnight in LB and then diluted 1:200 into 4 mL of M9 minimal medium containing 0.5% glucose. The cells are grown with shaking (250 rpm) for 4-6 h and incubated aerobically or anaerobically in a Coy anaerobic chamber (supplying 90% N2, 5% CO2, 5% H2). One mL culture aliquots are prepared in 1.5 mL capped tubes and incubated in a stationary incubator to limit culture aeration. One tube is removed at each time point (0, 1, 2, 4, and 20 hrs) and analyzed for butyrate concentration by LC-MS to confirm that butyrate production in these recombinant strains can be achieved in a low-oxygen environment.

Example 15. Production of Butyrate in Recombinant E. coli Using Tet-Inducible Promoter FIG. 2 shows butyrate cassettes described above under the control of a tet-inducible promoter. Production of butyrate is assessed using the methods described below in Example 22. The tet-inducible cassettes tested include (1) tet-butyrate cassette comprising all eight genes (pLOGIC031); (2) tet-butyrate cassette in which the ter is substituted (pLOGIC046) and (3) tet-butyarte cassette in which tesB is substituted in place of pbt and buk genes.

FIG. 6A shows butyrate production in strains pLOGIC031 and pLOGIC046 in the presence and absence of oxygen, in which there is no significant difference in butyrate production. Enhanced butyrate production was shown in Nissle in low copy plasmid expressing pLOGIC046 which contain a deletion of the final two genes (ptb-buk) and their replacement with the endogenous E. coli tesB gene (a thioesterase that cleaves off the butyrate portion from butyryl CoA).

Figure 6B:
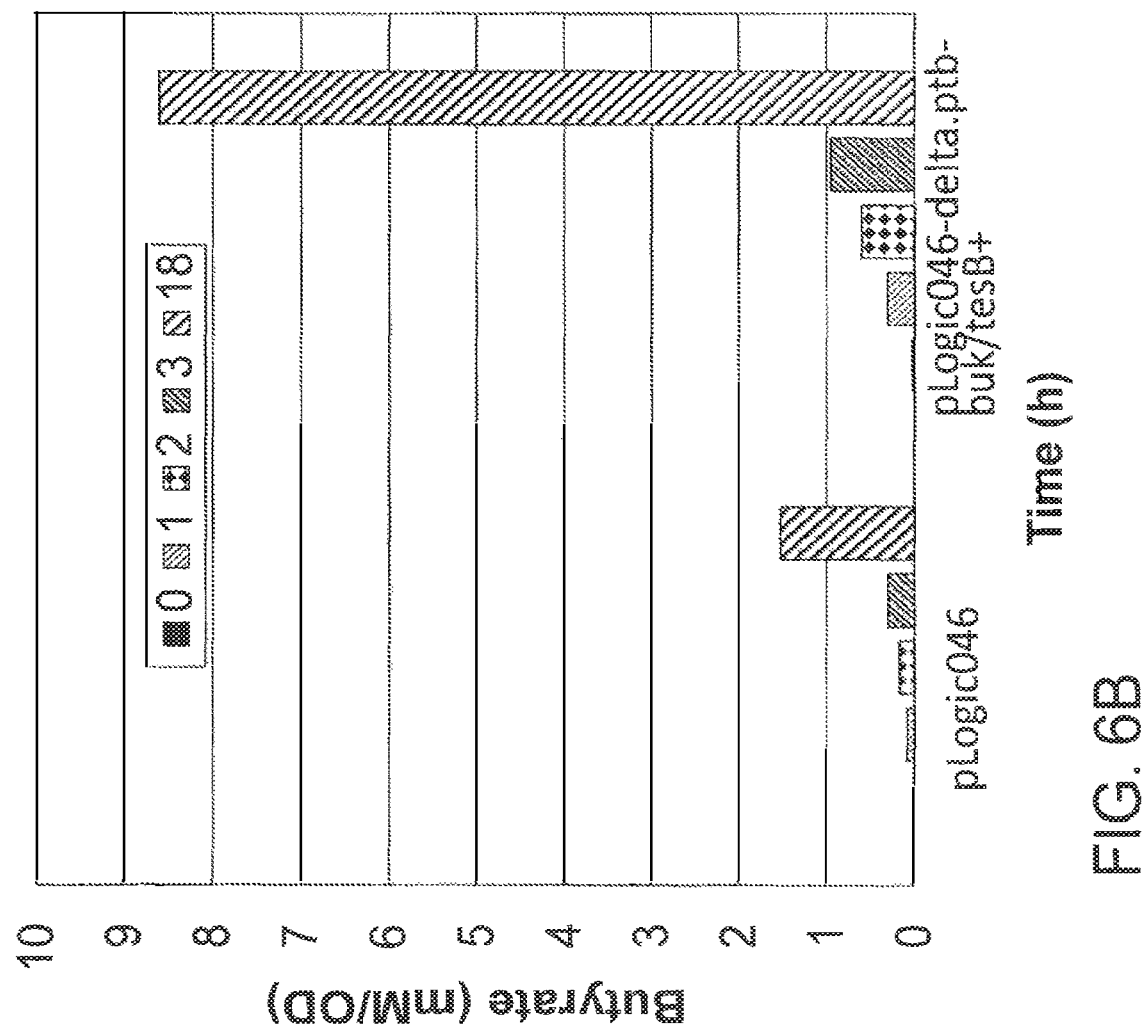
FIG. 6B depicts butyrate production of pLogic046 (ter butyrate cassette under control of tet promoter on a plasmid)) and a Nissle strain comprising plasmid pLOGIC046-delta pbt.buk/tesB+, an ATC-inducible ter-comprising butyrate construct with a deletion in the pbt-buk genes and their replacement with the tesB gene. The tesB construct results in greater butyrate production.

Overnight cultures of cells were diluted 1:100 in Lb and grown for 1.5 hours until early log phase was reached at which point anhydrous tet was added at a final concentration of 100 ng/ml to induce plasmid expression. After 2 hours induction, cells were washed and resuspended in M9 minimal media containing 0.5% glucose at OD600=0.5. Samples were removed at indicated times and cells spun down. The supernatant was tested for butyrate production using LC-MS. FIG. 6B shows butyrate production in strains comprising a tet-butyrate cassette having ter substitution (pLOGIC046) or the tesB substitution (ptb-buk deletion), demonstrating that the tesB substituted strain has greater butyrate production.

Figure 7:
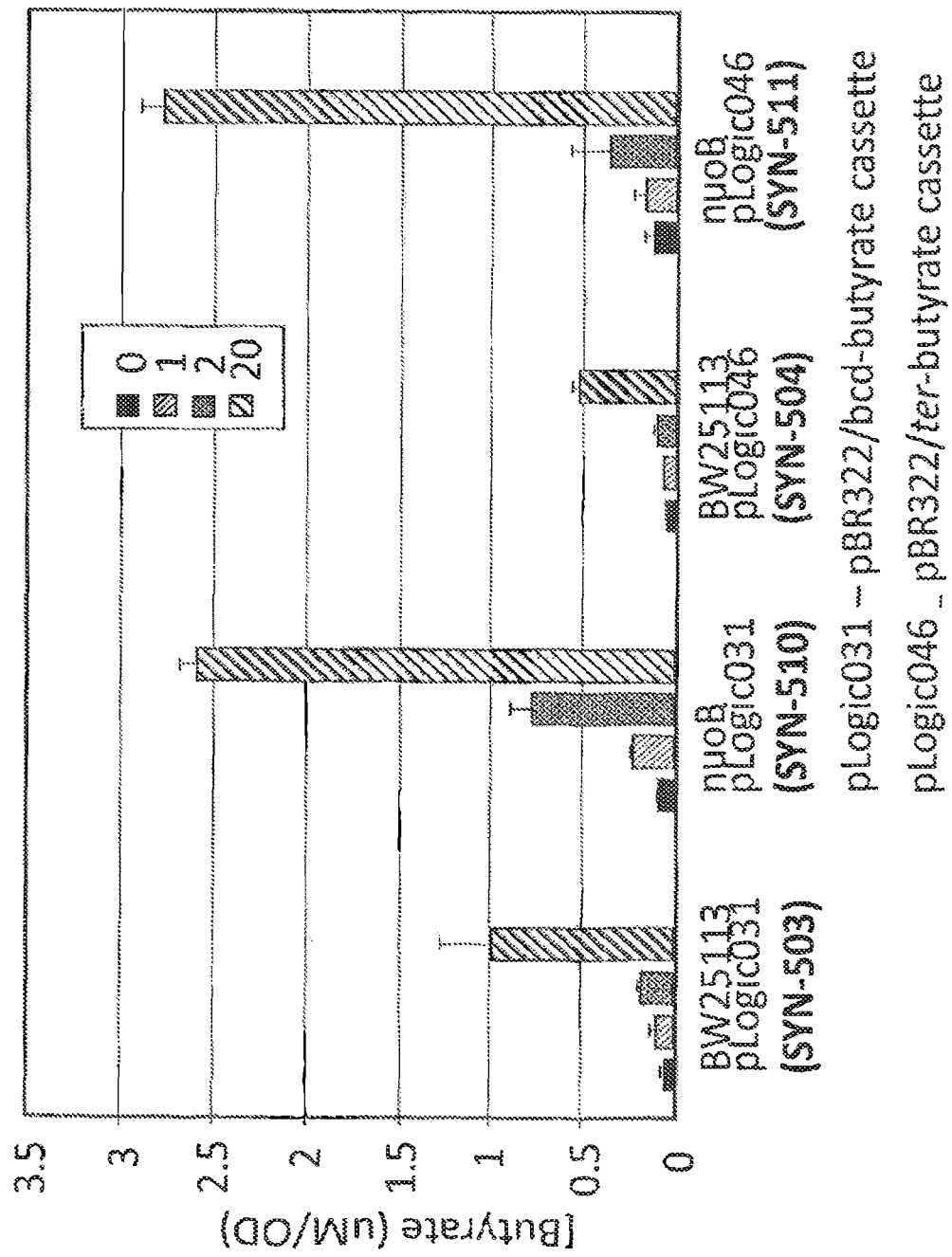
FIG. 7 depicts a graph of butyrate production using different butyrate-producing circuits comprising a nuoB gene deletion. Strains depicted are SYN-UCD503, SYN-UCD504, SYN-UCD510 (SYN-UCD510 is the same as SYN-UCD503 except that it further comprises a nuoB deletion), and SYN-UCD511 (SYN-UCD511 is the same as SYN-UCD504 except that it further comprises a nuoB deletion). The NuoB gene deletion results in greater levels of butyrate production as compared to a wild-type parent control in butyrate producing strains. NuoB is a main protein complex involved in the oxidation of NADH during respiratory growth. In some embodiments, preventing the coupling of NADH oxidation to electron transport increases the amount of NADH being used to support butyrate production.

FIG. 7 shows the BW25113 strain of E. coli, which is a common cloning strain and the background of the KEIO collection of E. coli mutants. NuoB mutants having NuoB deletion were obtained. NuoB is a protein complex involved in the oxidation of NADH during respiratory growth (form of growth requiring electron transport). Preventing the coupling of NADH oxidation to electron transport allows an increase in the amount of NADH being used to support butyrate production. FIG. 7 shows that compared with wild-type Nissle, deletion of NuoB results in grater production of butyrate.

TABLE 37 pLOGIC046-tesB-butyrate
pLOGIC046-tesB-butyrate: SEQ ID NO: 208

```
gtaaaacgacggccagtgaattcgttaagacccactttcacatttaagttgttt
ttctaatccgcatatgatcaattcaaggccgaataagaaggctggctctgcaccttggt
gatcaaataattcgatagcttgtcgtaataatggcggcatactatcagtagtaggtgtt
tccctttcttctttagcgacttgatgctcttgatcttccaatacgcaacctaaagtaaa
atgccccacagcgctgagtgcatataatgcattctctagtgaaaaaccttgttggcata
```

TABLE 37-continued pLOGIC046-tesB-butyrate
pLOGIC046-tesB-butyrate: SEQ ID NO: 208

```
aaaaggctaattgattttcgagagtttcatactgttttttctgtaggccgtgtacctaaa
tgtacttttgctccatcgcgatgacttagtaaagcacatctaaaacttttagcgttatt
acgtaaaaaatcttgccagctttccccttctaaagggcaaaagtgagtatggtgcctat
ctaacatctcaatggctaaggcgtcgagcaaagcccgcttattttttacatgccaatac
aatgtaggctgctctacacctagcttctgggcgagtttacgggttgttaaaccttcgat
tccgacctcattaagcagctctaatgcgctgttaatcacttttacttttatctaatctag
acatcattaattcctaattttttgttgacactctatcattgatagagttatttttaccact
ccctatcagtgatagagaaaagtgaactctagaaataattttgtttaacttttaagaagg
agatatacatatgatcgtaaaacctatggtacgcaacaatatctgcctgaacgcccatc
ctcagggctgcaagaagggagtggaagatcagattgaatataccaagaaacgcattacc
gcagaagtcaaagctggcgcaaaagctccaaaaaacgttctggtgcttggctgctcaaa
tggttacggcctggcgagccgcattactgctgcgttcggatacggggctgcgaccatcg
gcgtgtcctttgaaaaagcgggttcagaaaccaaatatggtacaccgggatggtacaat
aatttggcatttgatgaagcggcaaaacgcgagggtctttatagcgtgacgatcgacgg
cgatgcgttttcagacgagatcaaggcccaggtaattgaggaagccaaaaaaaaaggta
tcaaatttgatctgatcgtatacagcttggccagcccagtacgtactgatcctgataca
ggtatcatgcacaaaagcgttttgaaaccctttggaaaaacgttcacaggcaaaacagt
agatccgtttactggcgagctgaaggaaatctccgcggaaccagcaaatgacgaggaag
cagccgccactgttaaagttatggggggtgaagatgggaacgttggattaagcagctg
tcgaaggaaggcctcttagaagaaggctgtattaccttggcctatagttatattggccc
tgaagctacccaagctttgtaccgtaaaggcacaatcggcaaggccaaagaacacctgg
aggccacagcacaccgtctcaacaaagagaacccgtcaatccgtgccttcgtgagcgtg
aataaaggcctggtaacccgcgcaagcgccgtaatcccggtaatccctctgtatctcgc
cagcttgttcaaagtaatgaaagagaagggcaatcatgaaggttgtattgaacagatca
cgcgtctgtacgccgagcgcctgtaccgtaaagatggtacaattccagttgatgaggaa
aatcgcattcgcattgatgattgggagttagaagaagacgtccagaaagcggtatccgc
gttgatggagaaagtcacgggtgaaaacgcagaatctctcactgacttagcggggtacc
gccatgatttcttagctagtaacggctttgatgtagaaggtattaattatgaagcggaa
gttgaacgcttcgaccgtatctgataagaaggagatacatatgagagaagtagtaat
tgccagtgcagctagaacagcagtaggaagttttggaggagcatttaaatcagtttcag
cggtagagttagggggtaacagcagctaaagaagctataaaaaagagctaacataactcca
gatatgatagatgaatctcttttagggggagtacttacagcaggtcttggacaaaatat
agcaagacaaatagcattaggagcaggaataccagtagaaaaaaccagctatgactataa
atatagtttgtggttctggattaagatctgtttcaatggcatctcaacttatagcatta
ggtgatgctgatataatgttagttggtggagctgaaaacatgagtatgtctcccttattt
agtaccaagtgcgagatatggtgcaagaatgggtgatgctgcttttgttgattcaatga
taaaagatggattatcagacatatttaataactatcacatgggtattactgctgaaaac
atagcagagcaatggaatataactagagaagaacaagatgaattagctcttgcaagtca
aaataaagctgaaaaagctcaagctgaaggaaaatttgatgaagaaatagttcctgttg
ttataaaaggaagaaaaggtgacactgtagtagataaagatgaatatattaagcctggc
actacaatggagaaacttgctaagttaagacctgcatttaaaaaagatggaacagttac
tgctggtaatgcatcaggaataaatgatggtgctgctatgttagtagtaatggctaaag
aaaagctgaagaactaggaatagagcctcttgcaactatagtttcttatggaacagct
ggtgttgaccctaaaataatgggatatgaccagttccagcaactaaaaaaagctttaga
agctgctaatatgactattgaagatatagatttagttgaagctaatgaggcatttgctg
cccaatctgtagctgtaataagagacttaaatatagatatgaataaagttaatgttaat
ggtggagcaatagctataggacatcccaataggatgctcaggagcaaatacttactac
acttttatatgaaatgaagagaagagatgctaaaactggtcttgctacacttgtatag
gcggtggaatgggaactactttaatagttaagagatagtaagaaggagatatacatatg
aaattagctgtaataggtagtggaactatgggaagtggtattgtacaaacttttgcaag
ttgtggacatgtgtatgtttaaagagtagaactcaaggtgctatagataaatgtttag
ctttattagataaaaatttaactaagttagttactaagggaaaaattggatgaagctaca
aaagcagaaatattaagtcatgttagttcaactactaattatgaagatttaaaagatat
ggatttaataatagaagcatctgtagaagacatgaatataaagaaagatgttttcaagt
tactagatgaattatgtaaagaagatactatcttggcaacaaatacttcatcattatct
ataacagaaatagcttcttctactaagcgcccagataaagttataggaatgcattttctt
taatccagttcctatgatgaaattagttgaagttataagtggtcagttaacatcaaaag
ttacttttgatacagtatttgaattatctaagagtatcaataaagtaccagtagatgta
tctgaatctcctggatttgtagtaaatagaatacttatacctatgataaatgaagctgt
tggtatatatgcagatggtgttgcaagtaaagaagaaatagatgaagctatgaaattag
gagcaaaccatccaatgggaccactagcattaggtgatttaatcggattagatgttgtt
ttagctataatgaacgttttatatactgaatttggagatactaaatatagacctcatcc
acttttagctaaaatggttagagctaatcaattaggaagaaaaactaagataggattct
atgattataaacataaataagaaggagatatacatatgagtcaagtgatgttaaagtt
tatgagaatgtagctgttgaagtagatggaaatatatgtacagtgaaaatgaatagacc
taaagcccttaatgcaataaattcaaagactttagaagaactttatgaagtatttgtag
atattaataatgatgaaactattgatgttgtaatattgacaggggaaggaaaggcattt
gtagctggagcagatattgcatacatgaaagattttagatgctgtagctgctaaagattt
tagtatcttaggagcaaaagcttttgagaaatagaaatagtaaaaagtagtgatag
ctgctgtaaacggatttgctttaggtggaggatgtgaacttgcaatggcatgtgatata
agaattgcatctgctaaagctaaatttggtcagccagaagtaactcttggaataactcc
aggatatggaggaactcaaaggcttacaaggattggttggaatggcaaaagcaaaagaat
taatctttcacaggtcaagttataaaaagctgatgaagctgaaaaaatagggctagtaaat
agagtcgttgagccagacattttaatagaagaagttgagaaattagctaagataatagc
taaaaatgctcagcttgcagttagatactctaaagaagcaatacaacttggtgctcaaa
ctgatataaatactggaatagatatagaatctaatttatttggtctttgtttttcaact
aaagaccaaaaagaaggaatgtcagctttcgttgaaaagagagaagctaactttatataa
```

TABLE 37-continued pLOGIC046-tesB-butyrate
pLOGIC046-tesB-butyrate: SEQ ID NO: 208 agggtaataagaaggagatatacatatgAGTCAGGCGCTAAAAAATTTACTGACATTGT
TAAATCTGGAAAAAATTGAGGAAGGACTCTTTCGCGGCCAGAGTGAAGATTTAGGTTTA
CGCCAGGTGTTTGGCGGCCAGGTCGTGGGTCAGGCCTTGTATGCTGCAAAAGAGACCGT
CCCTGAAGAGCGGCTGGTACATTCGTTTCACAGCTACTTTCTTCGCCCTGGCGATAGTA
AGAAGCCGATTATTTATGATGTCGAAACGCTGCGTGACGGTAACAGCTTCAGCGCCCGC
CGGGTTGCTGCTATTCAAAACGGCAAACCGATTTTTTATATGACTGCCTCTTTCCAGGC
ACCAGAAGCGGGTTTCGAACATCAAAAAACAATGCCGTCCGCGCCAGCGCCTGATGGCC
TCCCTTCGGAAACGCAAATCGCCCAATCGCTGGCGCACCTGCTGCCGCCAGTGCTGAAA
GATAAATTCATCTGCGATCGTCCGCTGGAAGTCCGTCCGGTGGAGTTTCATAACCCACT
GAAAGGTCACGTCGCAGAACCACATCGTCAGGTGTGGATCCGCGCAAATGGTAGCGTGC
CGGATGACCTGCGCGTTCATCAGTATCTGCTCGGTTACGCTTCTGATCTTAACTTCCTG
CCGGTAGCTCTACAGCCGCACGGCATCGGTTTTCTCGAACCGGGGATTCAGATTGCCAC
CATTGACCATTCCATGTGGTTCCATCGCCCGTTTAATTTGAATGAATGGCTGCTGTATA
GCGTGGAGAGCACCTCGGCGTCCAGCGCACGTGGCTTTGTGCGCGGTGAGTTTTATACC
CAAGACGGCGTACTGGTTGCCTCGACCGTTCAGGAAGGGGTGATGCGTAATCACAATTa
a

Example 16. Production of Butyrate in Recombinant E. coli

Production of butyrate is assessed in E. coli Nissle strains containing the butyrate cassettes described above in order to determine the effect of oxygen on butyrate production. All incubations are performed at 37° C. Cultures of E. coli strains DH5 a and Nissle transformed with the butyrate cassettes are grown overnight in LB and then diluted 1:200 into 4 mL of M9 minimal medium containing 0.5% glucose. The cells are grown with shaking (250 rpm) for 4-6 h and incubated aerobically or anaerobically in a Coy anaerobic chamber (supplying 90% $N_2$, 5% $CO_2$, 5% $H_2$). One mL culture aliquots are prepared in 1.5 mL capped tubes and incubated in a stationary incubator to limit culture aeration. One tube is removed at each time point (0, 1, 2, 4, and 20 hours) and analyzed for butyrate concentration by LC-MS to confirm that butyrate production in these recombinant strains can be achieved in a low-oxygen environment.

In an alternate embodiment, overnight bacterial cultures were diluted 1:100 into fresh LB and grown for 1.5 hrs to allow entry into early log phase. At this point, long half-life nitric oxide donor (DETA-NO; diethylenetriamine-nitric oxide adduct) was added to cultures at a final concentration of 0.3 mM to induce expression from plasmid. After 2 hours of induction, cells were spun down, supernatant was discarded, and the cells were resuspended in M9 minimal media containing 0.5% glucose. Culture supernatant was then analyzed at indicated time points to assess levels of butyrate production. Genetically engineered Nissle comprising pLogic031-nsrR-norB-butyrate operon construct; SYN507) or (pLogic046-nsrR-norB-butyrate operon construct; SYN-508) produce significantly more butyrate as compared to wild-type Nissle.

Genetically engineered Nissle were generated comprising a butyrate gene cassette in which the pbt and buk genes are replaced with tesB (SEQ ID NO: 15) expressed under the control of a tetracycline promoter (pLOGIC046-tesB-butyrate; SEQ ID NO: 208). SEQ ID NO: 208 comprises a reverse complement of the tetR repressor (underlined), an intergenic region containing divergent promoters controlling tetR and the butyrate operon and their respective RBS (bold), and the butyrate genes (ter-thiA1-hbd-crt2-tesB) separated by RBS.

Overnight bacterial cultures were diluted 1:100 into fresh LB and grown for 1.5 hrs to allow entry into early log phase. At this point, anhydrous tetracycline (ATC) was added to cultures at a final concentration of 100 ng/mL to induce expression of butyrate genes from plasmid. After 2 hours of induction, cells were spun down, supernatant was discarded, and the cells were resuspended in M9 minimal media containing 0.5% glucose. Culture supernatant was then analyzed at indicated time points to assess levels of butyrate production. Replacement of pbt and buk with tesB leads to greater levels of butyrate production.

Figure 8A:
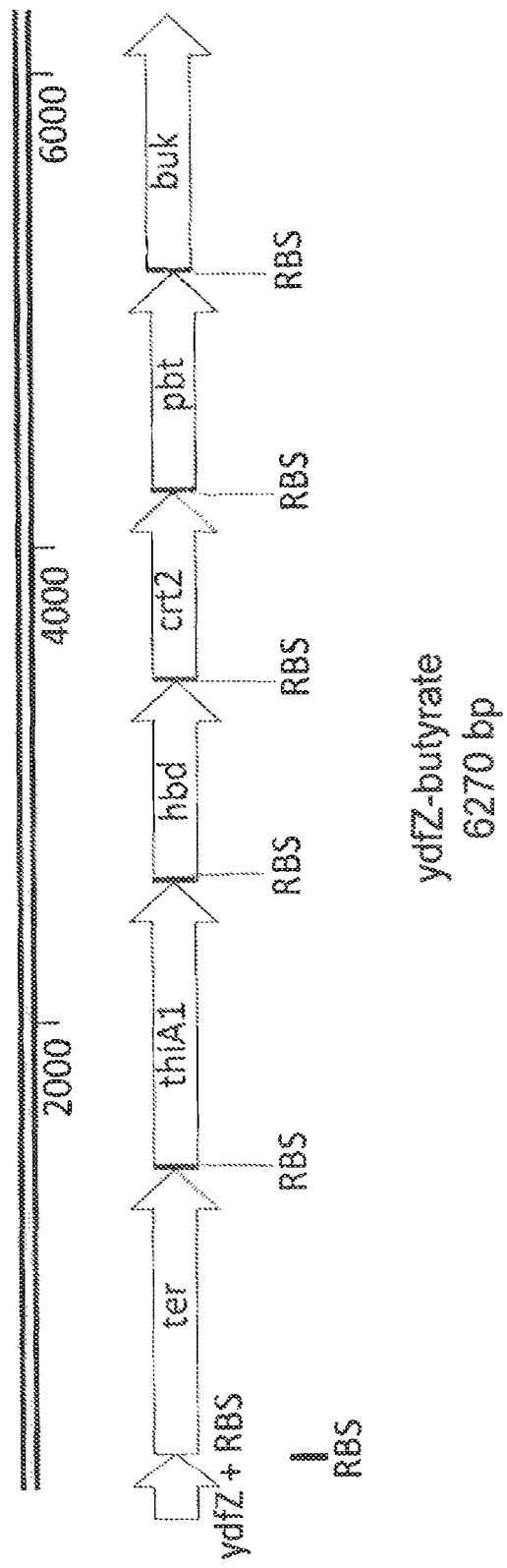
FIG. 8A depicts a schematic of a butyrate producing circuit under the control of an FNR promoter.
Figure 8C:
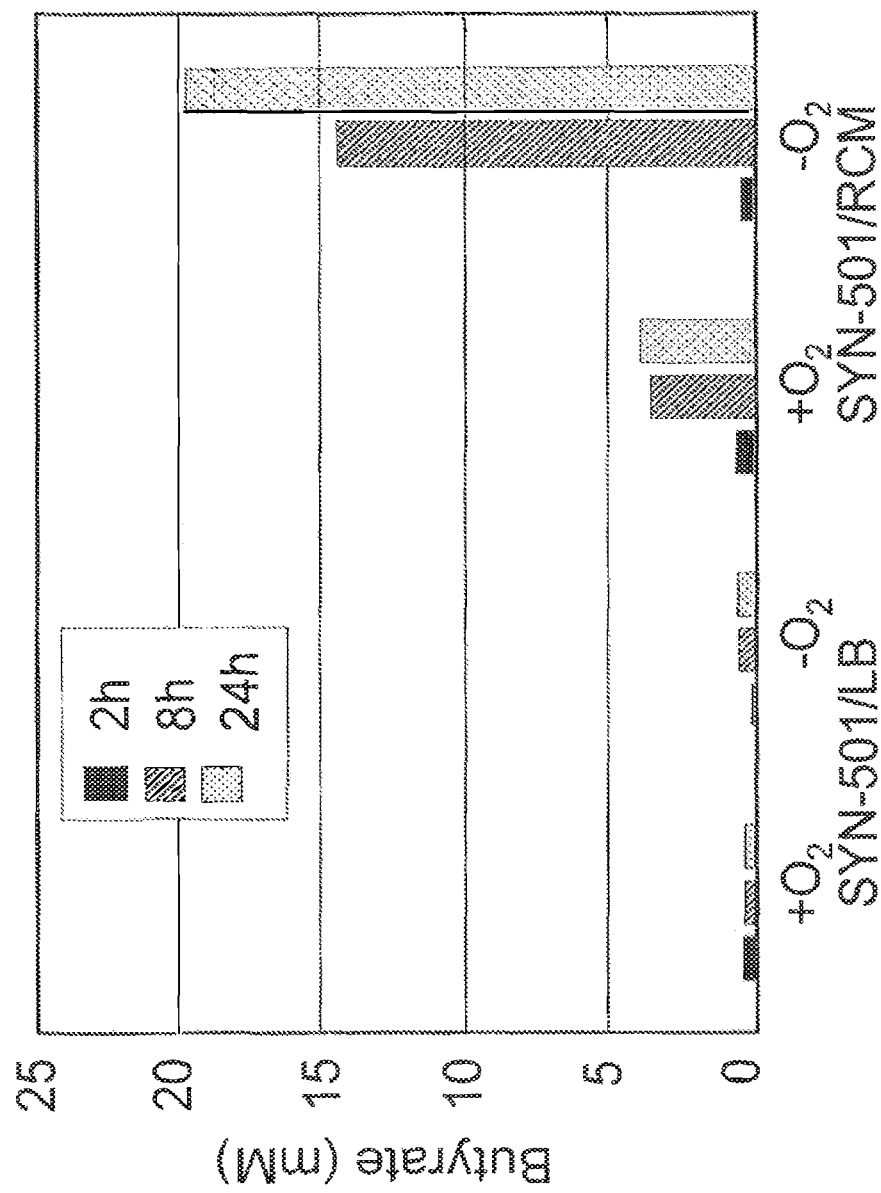
FIG. 8B depicts a bar graph of anaerobic induction of butyrate production. FNR-responsive promoters were fused to butyrate cassettes containing either the bcd or ter circuits. Transformed cells were grown in LB to early log and placed in anaerobic chamber for 4 hours to induce expression of butyrate genes. Cells were washed and resuspended in minimal media w/0.5% glucose and incubated microaerobically to monitor butyrate production over time. SYN-UCD501 led to significant butyrate production under anaerobic conditions.

FIG. 8C shows butyrate production in strains comprising an FNR-butyrate cassette SYN501 (having the ter substitution) in the presence/absence of glucose and oxygen. FIG. 8C shows that bacteria need both glucose and anaerobic conditions for butyrate production from the FNR promoter. Cells were grown aerobically or anaerobically in media containing no glucose (LB) or in media containing glucose at 0.5% (RMC). Culture samples were taken at indicated time pints and supernatant fractions were assessed for butyrate concentration using LC-MS. These data show that SYN501 requires glucose for butyrate production and that in the presence of glucose butyrate production can be enhanced under anaerobic conditions when under the control of the anaerobic FNR-regulated ydfZ promoter.

TABLE 38

Butyrate cassette sequences

| Description | Sequence | SEQ ID NO |
|---|---|---|
| ydfZ + RBS (RBS is bolded) | CATTTCCTCTCATCCCATCCGGGGTGAGAGT CTTTTCCCCCGACTTATGGCTCATGCATGCAT CAAAAAAGATGTGAGCTTGATCAAAAACAA AAAATATTTCACTCGACAGGAGTATTTATAT TGCGCCCGGATCCCTCTAGAAATAATTTTGT TTAACTTTAAGAAGGAGATATACAT | SEQ ID NO: 209 |

TABLE 38-continued

Butyrate cassette sequences

| Description | Sequence | SEQ ID NO |
|---|---|---|
| First RBS (in ydfZ = RBS) | TTTGTTTAACTTTAAGAAGGAGA | SEQ ID NO: 210 |
| Internal RBS between genes | taagaaggagatatacat | SEQ ID NO: 211 |
| Butyrate cassette under the control of the ydfZ promoter (uppercase: ydfZ promoter, with RBS in bold; lower case: coding regions in the following order: ter, thiA, hbd, crt2, pbt, buk, separated by internal RBS (uppercase and underlined) | CATTTCCTCTCATCCCATCCGGGGTGAGAGT<br>CTTTTCCCCCGACTTATGGCTCATGCATGCAT<br>CAAAAAAGATGTGAGCTTGATCAAAAACAA<br>AAAATATTTCACTCGACAGGAGTATTTATAT<br>TGCGCCCGGATCCCTCTAGAAATAATTTTGT<br>TTAACTTTAAGAAGGAGATATACATatgatcgt<br>aaaacctatggtacgcaacaatatctgcctgaacgcccatcctcagggct<br>gcaagaagggagtggaagatcagattgaatataccaagaaacgcattac<br>cgcagaagtcaaagctggcgcaaaagctccaaaaaacgttctggtgctt<br>ggctgctcaaatggttacggcctggcgagccgcattactgctgcgttcgg<br>atacggggctgcgaccatcggcgtgtcctttgaaaaagcgggttcagaa<br>accaaatatggtacaccgggatggtacaataatttggcatttgatgaagcg<br>gcaaaacgcgagggtctttatagcgtgacgatcgacggcgatgcgttac<br>agacgagatcaaggcccaggtaattgaggaagccaaaaaaaaggtat<br>caaatttgatctgatcgtatacagcttggccagcccagtacgtactgatcct<br>gatacaggtatcatgcacaaaagcgttttgaaacccttttggaaaaacgttc<br>acaggcaaaacagtagatccgtttactggcgagctgaaggaaatctccg<br>cggaaccagcaaatgacgaggaagcagccgccactgttaaagttatgg<br>ggggtgaagattgggaacgttggattaagcagctgtcgaaggaaggcct<br>cttagaagaaggctgtattaccttggcctatagttatattggccctgaagct<br>acccaagctttgtaccgtaaaggcacaatcggcaaggccaaagaacacc<br>tggaggccacagcacaccgtctcaacaaagagaaccccgtcaatccgtg<br>ccttcgtgagcgtgaataaaggcctggtaacccgcgcaagcgccgtaat<br>cccggtaatccctctgtatctcgccagcttgttcaaagtaatgaaagagaa<br>gggcaatcatgaaggttgtattgaacagatcacgcgtctgtacgccgagc<br>gcctgtaccgtaaagatggtacaattccagttgatgaggaaaatcgcattc<br>gcattgatgattgggagttagaagaagacgtccagaaagcggtatccgc<br>gttgatggagaaagtcacgggtgaaaacgcagaatctctcactgacttag<br>cggggtaccgccatgatttcttagctagtaacggctttgatgtagaaggtat<br>taattatgaagcggaagttgaacgcttcgaccgtatctga<u>TAAGAA</u><br><u>GGAGATATACAT</u>atgagagaagtagtaattgccagtgcagct<br>agaacagcagtaggaagttttggaggagcatttaaatcagtttcagcggta<br>gagttaggggtaacagcagctaaagaagctataaaaaagagctaacataa<br>ctccagatatgatagatgaatctcttttaggggagtacttacagcaggtct<br>tggacaaaatatagcaagacaaatagcattaggagcaggaataccagta<br>gaaaaaccagctatgactataaatatagtttgtggttctggattaagatctgt<br>ttcaatggcatctcaacttatagcattaggtgatgctgatataatgttagttg<br>gtggagctgaaaacatgagtatgtctccttatttagtaccaagtgcgagata<br>tggtgcaagaatgggtgatgctgcttttgttgattcaatgataaaagatgga<br>ttatcagacatatttaataactatcacatgggtattactgctgaaaacatagc<br>agagcaatggaatataactagagaagaacaagatgaattagctcttgcaa<br>gtcaaaatataaagctgaaaaagctcaagctgaaggaaaatttgatgaagaa<br>atagacctgagttataaaaggaagaaaaggtgacactgtagtagataaa<br>gatgaatatattaagcctggcactacaatggagaaacttgctaagttaaga<br>cctgcatttaaaaaagatggaacagttactgctggtaatgcatcaggaata<br>aatgatggtgctgctatgttagtagtaatggctaaagaaaaagctgaagaa<br>ctaggaatagagcctcttgcaactatagtttcttatggaacagctggtgttg<br>accctaaaatatgggatatggaccagaccagcaactaaaaaagattag<br>aagctgctaatatgactattgaagatatagatttagagaagctaatgaggc<br>atttgctgcccaatctgtagctgtaataagagacttaaatatagatatgaata<br>aagttaatgttaatggtggagcaatagctataggacatccaataggatgct<br>caggagcaagaatacttactacactatatatgaaatgaagagaagagatg<br>ctaaaactggtcttgctacactagtataggcggtggaatgggaactacat<br>aatagttaagagatag<u>TAAGAAGGAGATATACAT</u>atgaa<br>attagctgtaataggtagtggaactatgggaagtggtattgtacaaactat<br>gcaagttgtggacatgatgtatgtttaaagagtagaactcaaggtgctata<br>gataaatgatagattattagataaaaatttaactaagttagttactaaggga<br>aaaatggatgaagctacaaaagcagaaatattaagtcatgttagttcaact<br>actaattatgaagatttaaaagatatggatttaataatagaagcatctgtaga<br>agacatgaatataaagaaagatgattcaagttactagatgaattatgtaaa<br>gaagatactatcaggcaacaaatacttcatcattatctctataacagaaatag<br>cacactactaagcgcccagataaagttataggaatgcatttattaatcca<br>gttcctatgatgaaattagttgaagttataagtggtcagttaacatcaaaagt<br>tacattgatacagtatttgaattatctaaagagtatcaataaagtaccagtaga<br>tgtatctgaatctcctggatagtagtaaatagaatacttataccatgataaa<br>tgaagctgaggtatatatgcagatggtgagcaagtaaagaagaaatag<br>atgaagctatgaaattaggagcaaaccatccaatgggaccactagcattag<br>gtgatttaatcggattagatgagattagctctaatgaacgattatatactga<br>ataggagatactaaatatagacctcatccactatagctaaaatggttagag |  SEQ ID NO: 212 |

TABLE 38-continued

Butyrate cassette sequences

| Description | Sequence | SEQ ID NO |
|---|---|---|
| | ctaatcaattaggaagaaaaactaagataggattctatgattataataaata<br>aTAAGAAGGAGATATACATatgagtacaagtgatgttaa<br>agatatgagaatgtagctgagaagtagatggaaatatatgtacagtgaaa<br>atgaatagacctaaagcccttaatgcaataaattcaaagactttagaagaa<br>catatgaagtatagtagatattaataatgatgaaactattgatgagtaatatt<br>gacagggaaggaaaggcatttgtagctggagcagatattgcatacatg<br>aaagatttagatgctgtagctgctaaagatatagtatcttaggagcaaaag<br>cattggagaaatagaaaatagtaaaaaagtagtgatagctgctgtaaacg<br>gatttgattaggtggaggatgtgaacttgcaatggcatgtgatataagaat<br>tgcatctgctaaagctaaataggtcagccagaagtaactcaggaataact<br>ccaggatatggaggaactcaaaggcttacaagattggaggaatggcaa<br>aagcaaaagaattaatattacaggtcaagttataaaagctgatgaagctg<br>aaaaaatagggctagtaaatagagtcgttgagccagacatataatagaag<br>aagttgagaaattagctaagataatagctaaaaatgctcagcttgcagtta<br>gatactctaaagaagcaatacaacttggtgctcaaactgatataaatactg<br>gaatagatatagaatctaatttataggtattgatttcaactaaagaccaaaa<br>agaaggaatgtcagctttcgttgaaaagagagaagctaactttataaaag<br>ggtaaTAAGAAGGAGATATACATatgagaagattgaag<br>aagtaattaagtagcaaaagaaagaggacctaaaactatatcagtagcat<br>gagccaagataaagaagattaatggcagttgaaatggctagaaaagaa<br>aaaatagcaaatgccatatagtaggagatatagaaaagactaaagaaatt<br>gcaaaaagcatagacatggatatcgaaaattatgaactgatagatataaaa<br>gatttagcagaagcatctctaaaatctgttgaattagtttcacaaggaaaag<br>ccgacatggtaatgaaaggcttagtagacacatcaataatactaaaagca<br>gattaaataaagaagtaggtcttagaactggaaatgtattaagtcacgtag<br>cagtatttgatgtagagggatatgatagattattatcgtaactgacgcagct<br>atgaacttagctcctgatacaaatactaaaaagcaaatcatagaaaatgctt<br>gcacagtagcacattcattagatataagtgaaccaaaagagctgcaatat<br>gcgcaaaagaaaagtaaatccaaaaatgaaagatacagttgaagctaa<br>agaactagaagaaatgtatgaaagaggagaaatcaaaggagtatggag<br>gtgggccattgcaattgataatgcagtatattagaagcagctaaacataa<br>aggtataaatcatcctgtagcaggacgagctgatatattattagccccaga<br>tattgaaggtggtaacatattatataaagctaggtattcactcaaaatcaaa<br>aaatgcaggagttatagaggggctaaagcaccaataatattaacactag<br>agcagacagtgaagaaactaaactaaactcaatagattaggtgattaatg<br>gcagcaaaggcataaTAAGAAGGAGATATACATatga<br>gcaaaatatttaaaatcttaacaataaatcctggacgacatcaactaaaata<br>gctgtatttgataatgaggatttagtatttgaaaaaactttaagacattatca<br>gaagaaataggaaaatatgagaaggtgtctgaccaatttgaatttcgtaaa<br>caagtaatagaagaagctctaaaagaaggtggagtaaaaacatctgaatt<br>agatgctgtagtaggtagaggaggacacttaaacctataaaaggtggtac<br>ttattcagtaagtgctgctatgattgaagatttaaaagtgggagattaggag<br>aacacgcttcaaacctaggtggaataatagcaaaacaaataggtgaaga<br>agtaaatgaccacatacatagtagaccctgagagtagatgaattagaag<br>atgagctagaatactggtatgcctgaaataagtagagcaagtgtagtaca<br>tgattaaatcaaaaggcaatagcaagaagatatgctagagaaataaaca<br>agaaatatgaagatataaatcttatagagcacacatgggtggaggagatc<br>tgttggagctcataaaaatggtaaaatagtagatgttgcaaacgcattagat<br>ggagaaggacctttctctccagaaagaagtggtggactaccagtaggtg<br>cattagtaaaaatgtgattagtggaaaatatactcaagatgaaattaaaaa<br>gaaaataaaaggtaatggcggactagagcatacttaaacactaatgatgc<br>tagagaagttgaagaaagaattgaagctggtgatgaaaaagctaaattag<br>tatatgaagctatggcatatcaaatctctaaagaaataggagctagtgctg<br>cagacttaagggagatgtaaaagcaatattattaactggtgaaatcgcata<br>ttcaaaaatgatacagaaatgattgcagatagagttaaatttatagcagatg<br>taaaagatatccaggtgaagatgaaatgattgcattagctcaaggtggact<br>tagagattaactggtgaagaagaggctcaagatatgataactaataa | |

In some embodiments, the genetically engineered bacteria comprise the nucleic acid sequence of SEQ ID NO: 212 or a functional fragment thereof. In some embodiments, the genetically engineered bacteria comprise a nucleic acid sequence that, but for the redundancy of the genetic code, encodes the same polypeptide as SEQ ID NO: 212 or a functional fragment thereof. In some embodiments, genetically engineered bacteria comprise a nucleic acid sequence that is at least about 80%, at least about 85%, at least about 90%, at least about 95%, or at least about 99% homologous to the DNA sequence of SEQ ID NO: 212 or a functional fragment thereof, or a nucleic acid sequence that, but for the redundancy of the genetic code, encodes the same polypeptide as SEQ ID NO: 212 or a functional fragment thereof.

In alternate embodiments, pbt and buk are replaced with TesB (SEQ ID NO: 15)

In some embodiments, the butyrate cassette is driven by an inducible promoter. For example, other FNR promoters can be used in lieu of ydfZ, e.g., in SEQ ID NO: 177-188.

Non-limiting FNR promoter sequences are provided herein. In some embodiments, the genetically engineered bacteria of the invention comprise a butyrate cassette under the control of one or more of promoter sequences found in Table 6, e.g., nirB promoter, ydJZ promoter, nirB promoter fused to a strong ribosome binding site, ydfZ promoter fused to a strong ribosome binding site, fnrS, an anaerobically induced small RNA gene (fnrS promoter), nirB promoter fused to a crp binding site, and fnrS fused to a crp binding site.

In some embodiments, the butyrate cassette is under the control of a promoter which is inducible by metabolites present in the gut. In some embodiments the butyrate cassette is induced by HE-specific molecules or metabolites indicative of liver damage, e.g., bilirubin. In some embodiments, the butyrate cassette is placed under the control of promoter, which is inducible by inflammation or an inflammatory response (e.g., RNS or ROS promoter).

In some embodiments, the genetically engineered bacteria comprise a butyrate cassette driven by a promoter induced by a molecule or metabolite. Promoters that respond to one of these molecules or their metabolites may be used in the genetically engineered bacteria provided herein.

In some embodiments, the butyrate cassette is inducible by arabinose and is driven by the AraBAD promoter.

Example 17. Comparison of In Vitro Butyrate Production Efficacy of Chromosomal Insertion and Plasmid-Bearing Engineered Bacterial Strains The in vitro butyrate production efficacy of engineered bacterial strains harboring a chromosomal insertion of a butyrate cassette was compared to a strain bearing a butyrate cassette on a plasmid. SYN1001 and SYN1002 harbor a chromosomal insertion between the agaI/rsmI locus of a butyrate cassette (either ter→tesB or ter+pbt-buk, respectively) driven by an fnr inducible promoter. These strains were compared side by side with the low copy plasmid strain SYN501 (Logic156 (pSC101 PydfZ-ter→pbt-buk butyrate plasmid) also driven by an fnr inducible promoter. Butyrate levels in the media were measured at 4 and 24 hours post anaerobic induction.

Briefly, 3 ml LB was inoculated with bacteria from frozen glycerol stocks. Bacteria were grown overnight at 37 C with shaking. Overnight cultures were diluted 1:100 dilution into 10 ml LB (containing antibiotics) in a 125 ml baffled flask. Cultures were grown aerobically at 37 C with shaking for about 1.5 h, and then transferred to the anaerobic chamber at 37 C for 4 h. Bacteria ($2 \times 10^8$ CFU) were added to 1 ml M9 media containing 50 mM MOPS with 0.5% glucose in microcentrifuge tubes. Cells were plated to determine cell counts. The assay tubes were placed in the anaerobic chamber at 37 C. At indicated times (4 and 24 h), 120 ul cells were removed and pelleted at 14,000 rpm for 1 min, and 100 ul of the supernatant was transferred to a 96-well assay plate and sealed with aluminum foil, and stored at −80 C until analysis by LC-MS for butyrate concentrations (as described in Example 22). Results are depicted in FIG. 11, and show that SYN1001 and SYN1002 give comparable butyrate production to the plasmid strain SYN501.

TABLE 39

| FRNRs Butyrate Cassette Sequences | |
|---|---|
| Description | Sequence |
| Pfnrs-ter-thiA1-hbd-ctr2-tesB SEQ ID NO: 213, e.g. integrated into the chromosome in SYN1001 Pfnrs: uppercase; butyrate cassette: lower case | GGTACCAGTTGTTCTTATTGGTGGTGTTGCTTTAT GGTTGCATCGTAGTAAATGGTTGTAACAAAAGC AATTTTTCCGGCTGTCTGTATACAAAAACGCCGC AAAGTTTGAGCGAAGTCAATAAACTCTCTACCC ATTCAGGGCAATATCTCTCTTGGATCCAAAGTGA ACTCTAGAAATAATTTTGTTTAACTTTAAGAAGG AGATATACATatgatcgtaaaacctatggtacgcaacaatatctgcctg aacgcccatcctcagggctgcaagaagggagtggaagatcagattgaatatac caagaaacgcattaccgcagaagtcaaagctggcgcaaaagctccaaaaaac gttctggtgcttggctgctcaaatggttacggcctggcgagccgcattactgctg cgttcggatacggggctgcgaccatcggcgtgtcctttgaaaaagcgggttcag aaaccaaatatggtacaccgggatggtacaataatttggcatttgatgaagcggc aaaacgcgagggtcttttatagcgtgacgatcgacggcgatgcgttttcagacga gatcaaggcccaggtaattgaggaagccaaaaaaaaaggtatcaaatttgatct gatcgtatacagcttggccagcccagtacgtactgatcctgatacaggtatcatg cacaaaagcgttttgaaaccccttggaaaaacgttcacaggcaaaacagtagatc cgtttactggcgagctgaaggaaatctccgcggaaccagcaaatgacgaggaa gcagccgccactgttaaagttatggggggtgaagattgggaacgaggattaag cagctgtcgaaggaaggcctcttagaagaaggctgtattaccttggcctatagtt atattggccctgaagctacccaagctagtaccgtaaaggcacaatcggcaagg ccaaagaacacctggaggccacagcacaccgtctcaacaaagagaacccgtc aatccgtgccacgtgagcgtgaataaaggcctggtaacccgcgcaagcgccg taatcccggtaatccctctgtatctcgccagcttgacaaagtaatgaaagagaag ggcaatcatgaaggagtattgaacagatcacgcgtctgtacgccgagcgcctgt accgtaaagatggtacaattccagttgatgaggaaaatcgcattcgcattgatgat tgggagttagaagaagacgtccagaaagcggtatccgcgttgatggagaaagt cacgggtgaaaacgcagaatctctcactgacttagcggggtaccgccatgattt cttagctagtaacggattgatgtagaaggtattaattatgaagcggaagttgaac gcttcgaccgtatctgataagaaggagatatacatatgagagaagtagtaattgc cagtgcagctagaacagcagtaggaagattggaggagcatttaaatcagatca gcggtagagttaggggtaacagcagctaaagaagctataaaaagagctaacat aactccagatatgatagatgaatctcattaggggagtacttacagcaggtatg gacaaaatatagcaagacaaatagcattaggagcaggaataccagtagaaaaa ccagctatgactataaatatagtagtggactggattaagatctgatcaatggcat ctcaacttatagcattaggtgatgctgatataatgttagaggtggagctgaaaaca tgagtatgtctccttatttagtaccaagtgcgagatatggtgcaagaatgggtgat gctgatttgagattcaatgataaaagatggattatcagacatatttaataactatca catgggtattactgctgaaaacatagcagagcaatggaatataactagagaaga acaagatgaattagctcttgcaagtcaaaataaagctgaaaaagctcaagctgaa ggaaaatttgatgaagaaatagacctgagttataaaaggaagaaaaggtgaca ctgtagtagataaagatgaatatattaagcctggcactacaatggagaaacttgct |

TABLE 39-continued

FRNRs Butyrate Cassette Sequences

| Description | Sequence |
|---|---|
| | aagttaagacctgcatttaaaaaagatggaacagttactgctggtaatgcatcag<br>gaataaatgatggtgctgctatgttagtagtaatggctaaagaaaaagctgaaga<br>actaggaatagagcctatgcaactatagtacttatggaacagctggtgagacc<br>ctaaaataatgggatatggaccagttccagcaactaaaaaagctttagaagctgc<br>taatatgactattgaagatatagatttagttgaagctaatgaggcatttgctgccca<br>atctgtagctgtaataagagacttaaatatagatatgaataaagttaatgttaatggt<br>ggagcaatagctataggacatccaataggatgctcaggagcaagaatacttact<br>acactatatatgaaatgaagagaagagatgctaaaactggtatgctacactagt<br>ataggcggtggaatgggaactactttaatagttaagagatagtaagaaggagat<br>atacatatgaaattagctgtaataggtagtggaactatgggaagtggtattgtaca<br>aacattgcaagagtggacatgatgtatgataaagagtagaactcaaggtgctat<br>agataaatgatagattattagataaaaatttaactaagttagttactaagggaaaa<br>atggatgaagctacaaaagcagaaatattaagtcatgttagttcaactactaattat<br>gaagatttaaaagatatggatttaataatagaagcatctgtagaagacatgaatat<br>aaagaaagatgattcaagttactagatgaattatgtaaagaagatactatcaggc<br>aacaaatacttcatcattatctataacagaaatagcttcactactaagcgcccaga<br>taaagttataggaatgcatttattaatccagacctatgatgaaattagttgaagtta<br>taagtggtcagttaacatcaaaagttacattgatacagtatttgaattatctaagagt<br>atcaataaagtaccagtagatgtatctgaatctcctggatagtagtaaatagaata<br>cttatacctatgataaatgaagctgaggtatatatgcagatggtgagcaagtaaa<br>gaagaaatagatgaagctatgaaattaggagcaaaccatccaatgggaccacta<br>gcattaggtgatttaatcggattagatgagattagctataatgaacgattatatact<br>gaataggagatactaaatatagacctcatccactatagctaaaatggttagagct<br>aatcaattaggaagaaaaactaagataggattctatgattataataaataataaga<br>aggagatatacatatgagtacaagtgatgttaaagatatgagaagtgagctgaga<br>agtagatggaaatatatgtacagtgaaaatgaatagacctaaagcccttaatgca<br>ataaattcaaagactttagaagaactttatgaagtatttgtagatattaataatgatg<br>aaactattgatgttgtaatattgacaggggaaggaaaggcatttgtagctggagc<br>agatattgcatacatgaaagatttagatgctgtagctgctaaagattttagtatctta<br>ggagcaaaagcttttggagaaatagaaaatagtaaaaaagtagtgatagctgct<br>gtaaacggatttgctttaggtggaggatgtgaacttgcaatggcatgtgatataag<br>aattgcatctgctaaagctaaatttggtcagccagaagtaactcttggaataactc<br>caggatatggaggaactcaaaggcttacaagattggttggaatggcaaaagca<br>aaagaattaatcttttacaggtcaagttataaaagctgatgaagctgaaaaaatagg<br>gctagtaaatagagtcgttgagccagacatttaatagaagaagttgagaaattag<br>ctaagataatagctaaaaatgctcagcttgcagttagatactctaaagaagcaata<br>caacttggtgctcaaactgatataaatactggaatagatatagaatctaatttatttg<br>gtctttgtttttcaactaaagaccaaaaagaaggaatgtcagctttcgttgaaaaga<br>gagaagctaactttataaaagggtaataagaaggagatatacatatgagtcagg<br>cgctaaaaaatttactgacattgttaaatctggaaaaaattgaggaaggactctttc<br>gcggccagagtgaagatttaggtttacgccaggtgtttggcggccaggtcgtgg<br>gtcaggccttgtatgctgcaaaagagaccgtccctgaagagcggctggtacatt<br>cgtttcacagctactttcttcgccctggcgatagtaagaagccgattatttatgatgt<br>cgaaacgctgcgtgacggtaacagcttcagcgcccgccgggttgctgctattca<br>aaacggcaaaccgattattatgactgcctattccaggcaccagaagcgggtt<br>tcgaacatcaaaaaacaatgccgtccgcgccagcgcctgatggcctcccttcgg<br>aaacgcaaatcgcccaatcgctggcgcacctgctgccgccagtgctgaaagat<br>aaattcatctgcgatcgtccgctggaagtccgtccggtggagtttcataacccact<br>gaaaggtcacgtcgcagaaccacatcgtcaggtgtggatccgcgcaaatggta<br>gcgtgccggatgacctgcgcgttcatcagtatctgctcggttacgcttctgatctta<br>acttcctgccggtagctctacagccgcacggcatcggttttctcgaaccggggat<br>tcagattgccaccattgaccattccatgtggttccatcgcccgtttaatttgaatgaa<br>tggctgctgtatagcgtggagagcacctcggcgtccagcgcacgtggctttgtg<br>cgcggtgagttttatacccaagacggcgtactggttgcctcgaccgttcaggaa<br>ggggtgatgcgtaatcacaattaa |
| Pfnrs-ter-thiA1-hbd-crt2-<br>pbt-buk<br>(SEQ ID NO: 214), e.g.<br>integrated into the<br>chromosome in<br>SYN1002<br>Pfnrs: uppercase; butyrate<br>cassette: lower case | GGTACCAGTTGTTCTTATTGGTGGTGTTGCTTTAT<br>GGTTGCATCGTAGTAAATGGTTGTAACAAAAGC<br>AATTTTTCCGGCTGTCTGTATACAAAAACGCCGC<br>AAAGTTTGAGCGAAGTCAATAAACTCTCTACCC<br>ATTCAGGGCAATATCTCTCTTGGATCCAAAGTGA<br>ACTCTAGAAATAATTTTGTTTAACTTTAAGAAGG<br>AGATATACATatgcgtaaaacctatggtacgcaacaatatctgcctg<br>aacgcccatcctcagggctgcaagaagggagtggaagatcagattgaatatac<br>caagaaacgcattaccgcagaagtcaaagctggcgcaaaagctccaaaaaac<br>gttctggtgcttggctgctcaaatggttacggcctggcgagccgcattactgctg<br>cgttcggatacggggctgcgaccatcggcgtgtcctttgaaaaagcgggttcag<br>aaaccaaatatggtacaccgggatggtacaataaatttggcatttgatgaagcggc<br>aaaacgcgagggtctttatagcgtgacgatcgacggcgatgcgttttcagacga<br>gatcaaggcccaggtaattgaggaagccaaaaaaaaggtatcaaatttgatct<br>gatcgtatacagcttggccagcccagtacgtactgatcctgatacaggtatcatg<br>cacaaaagcgttttgaaacccttttggaaaaacgttcacaggcaaaacagtagatc<br>cgtttactggcgagctgaaggaaatctccgcggaaccagcaaatgacgaggaa<br>gcagccgccactgttaaagttatggggggtgaagattgggaacgttggattaag<br>cagctgtcgaaggaaggcctcttagaagaaggctgtattaccttggcctatagtt<br>atattggccctgaagctacccaagctagtaccgtaaaggcacaatcggcaagg |

TABLE 39-continued

FRNRs Butyrate Cassette Sequences

| Description | Sequence |
|---|---|
| | ccaaagaacacctggaggccacagcacaccgtctcaacaaagagaacccgtc |
| | aatccgtgccacgtgagcgtgaataaaggcctggtaacccgcgcaagcgccg |
| | taatcccggtaatccctctgtatctcgccagcttgacaaagtaatgaaagagaag |
| | ggcaatcatgaaggagtattgaacagatcacgcgtctgtacgccgagcgcctgt |
| | accgtaaagatggtacaattccagttgatgaggaaaatcgcattcgcattgatgat |
| | tgggagttagaagaagacgtccagaaagcggtatccgcgttgatggagaaagt |
| | cacgggtgaaaacgcagaatctctcactgacttagcggggtaccgccatgattt |
| | cttagctagtaacggattgatgtagaaggtattaattatgaagcggaagttgaac |
| | gcttcgaccgtatctgataagaaggagatatacatatgagagaagtagtaattgc |
| | cagtgcagctagaacagcagtaggaagattggaggagcatttaaatcagatca |
| | gcggtagagttaggggtaacagcagctaaagaagctataaaaagagctaacat |
| | aactccagatatgatagatgaatctcattaggggagtacttacagcaggtatg |
| | gacaaaatatagcaagacaaatagcattaggagcaggaataccagtagaaaaa |
| | ccagctatgactataaatatagtagtggactggattaagatctgatcaatggcat |
| | ctcaacttatagcattaggtgatgctgatataatgttagaggtggagctgaaaaca |
| | tgagtatgtctccttatttagtaccaagtgcgagatatggtgcaagaatgggtgat |
| | gctgatttgagattcaatgataaaagatggattatcagacatatttaataactatca |
| | catgggtattactgctgaaaacatagcagagcaatggaatataactagagaaga |
| | acaagatgaattagctcttgcaagtcaaaataaagctgaaaaagctcaagctgaa |
| | ggaaaatttgatgaagaaatagacctgagttataaaaggaagaaaaggtgaca |
| | ctgtagtagataaagatgaatatattaagcctggcactacaatggagaaacttgct |
| | aagttaagacctgcatttaaaaaagatggaacagttactgctggtaatgcatcag |
| | gaataaatgatggtgctgctatgttagtagtaatggctaaagaaaaagctgaaga |
| | actaggaatagagcctatgcaactatagtacttatggaacagctggtgagacc |
| | ctaaaataatgggatatggaccagttccagcaactaaaaaagctttagaagctgc |
| | taatatgactattgaagatatagatttagttgaagctaatgaggcatttgctgccca |
| | atctgtagctgtaataagagacttaaatatagatatgaataaagttaatgttaatggt |
| | ggagcaatagctataggacatccaataggatgctcaggagcaagaatacttact |
| | acactatatgaaatgaagaagagatgctaaaactggtatgctacactagt |
| | ataggcggtggaatgggaactactttaatagttaagagatagtaagaaggagat |
| | atacatatgaaattagctgtaataggtagtggaactatgggaagtggtattgtaca |
| | aacattgcaagagtggacatgatgtatgataaagagtagaactcaaggtgctat |
| | agataaatgatagattattagataaaaatttaactaagttagttactaagggaaaa |
| | atggatgaagctacaaaaagcagaaatattaagtcatgttagttcaactactaattat |
| | gaagatttaaaagatatggatttaataatagaagcatctgtagaagacatgaatat |
| | aaagaaagatgattcaagttactagatgaattatgtaaagaagatactatcaggc |
| | aacaaatacttcatcattatctataacagaaatagcttcactactaagcgcccaga |
| | taaagttataggaatgcatttattaatccagacctatgatgaaattagttgaagtta |
| | taagtggtcagttaacatcaaaagttacattgatacagtatttgaattatctaagagt |
| | atcaataaagtaccagtgatgtatctgaatctcctggatagtagtaaatagaata |
| | cttatacctatgataaatgaagctgaggtatatatgcagatggtgagcaagtaaa |
| | gaagaaatagatgaagctatgaaattaggagcaaaccatccaatgggaccacta |
| | gcattaggtgatttaatcggattagatgagattagctataatgaacgattatatact |
| | gaataggagatactaaatatagacctcatccactatagctaaaatggttagagct |
| | aatcaattaggaagaaaaactaagataggattctatgattataataaataataaga |
| | aggagatatacatatgagtacaagtgatgttaaagatatggagaatgtagctgaga |
| | agtagatggaaatatatgtacagtgaaaatgaatagacctaaagcccttaatgca |
| | ataaattcaaagactttagaagaactttatgaagtatttgtagatattaataatgatg |
| | aaactattgatgagtaatattgacaggggaaggaaaggcatagtagctggagc |
| | agatattgcatacatgaaagatttagatgctgtagctgctaaagatatagtatctta |
| | ggagcaaaagcttttggagaaatagaaaatagtaaaaaagtagtgatagctgct |
| | gtaaacggatttgattaggtggaggatgtgaacttgcaatggcatgtgatataag |
| | aattgcatctgctaaagctaaatttggtcagccagaagtaactcttggaataactc |
| | caggatatggaggaactcaaaggcttacaagattggaggaatggcaaaagca |
| | aaagaattaatattacaggtcaagttataaaagctgatgaagctgaaaaaatagg |
| | gctagtaaatagagtcgttgagccagacatataatagaagaagttgagaaattag |
| | ctaagataatagctaaaaatgctcagcttgcagttagatactctaaagaagcaata |
| | caacttggtgctcaaactgatataaatactggaatagatatagaatctaatttatttg |
| | gtctttgttttcaactaaagaccaaaaagaaggaatgtcagcttttcgttgaaaaga |
| | gagaagctaactttataaaagggtaataagaaggagatatacatatgagaagatt |
| | gaagaagtaattaagtagcaaaagaaagaggacctaaaactatatcagtagcat |
| | gagccaagataaagaagattaatggcagttgaaatggctagaaaagaaaaat |
| | agcaaatgccatatagtaggagatatagaaaagactaaagaaattgcaaaaag |
| | catagacatggatatcgaaaattatgaactgatagatataaaagatttagcagaag |
| | catctctaaaatctgagaattagatcacaaggaaaagccgacatggtaatgaaa |
| | ggcttagtagacacatcaataatactaaaagcagattaaataaagaagtaggtct |
| | tagaactgaaatgtattaagtcacgtagcagtatttgatgtagagggatatgata |
| | gattattatcgtaactgacgcagctatgaacttagctcctgatacaaatactaaaa |
| | agcaaatcatagaaaatgcttgcacagtagcacattcattagatataagtgaacc |
| | aaaaagagctgcaatatgcgcaaaagaaaaagtaaatccaaaaatgaaagatac |
| | agttgaagctaaagaactagaagaaatgtatgaaagaggagaaatcaaaggag |
| | tatggaggtgggccattgcaattgataatgcagtatcatagaagcagctaaaca |
| | taaaggtataaatcatcctgtagcaggacgagctgatatattattagccccagata |
| | ttgaaggtggtaacatattatataaagctaggtattcactcaaaatcaaaaaatgc |
| | aggagttatagaggggctaaagcaccaataatattaacactagagcagacagt |
| | gaagaaactaaactaaactcaatagattaggtgattaatggcagcaaaggcata |

TABLE 39-continued

FRNRs Butyrate Cassette Sequences

| Description | Sequence |
|---|---|
| | ataagaaggagatatacatatgagcaaaatatttaaaatcttaacaataaatcctg<br>gacgacatcaactaaaatagctgtatttgataatgaggatttagtatttgaaaaaac<br>ataagacattatcagaagaaataggaaaatatgagaaggtgtctgaccaatttg<br>aatttcgtaaacaagtaatagaagaagctctaaaagaaggtggagtaaaaacat<br>ctgaattagatgctgtagtaggtagaggaggacacttaaacctataaaaggtggt<br>acttattcagtaagtgctgctatgattgaagatttaaaagtgggagattaggagaa<br>cacgcttcaaacctaggtggaataatagcaaaacaaataggtgaagaagtaaat<br>gaccacatacatagtagaccctgagagtagatgaattagaagatgagctagaa<br>tactggtatgcctgaaataagtagagcaagtgtagtacatgattaaatcaaaag<br>gcaatagcaagaagatatgctagagaaataaacaagaaatatgaagatataaat<br>cttatagagcacacatgggtggaggagtactgaggagctcataaaaatggtaa<br>aatagtagatgagcaaacgcattagatggagaaggacctactctccagaaaga<br>agtggtggactaccagtaggtgcattagtaaaaatgtgctttagtggaaaatatac<br>tcaagatgaaattaaaaagaaaataaaaggtaatggcggactagagcatactta<br>aacactaatgatgctagagaagttgaagaaagaattgaagctggtgatgaaaaa<br>gctaaattagtatatgaagctatggcatatcaaatctctaaagaaataggagctag<br>tgctgcagacttaagggagatgtaaaagcaatattattaactggtggaatcgcat<br>attcaaaaatgatacagaaatgattgcagatagagttaaatttatagcagatgtaa<br>aagtttatccaggtgaagatgaaatgattgcattagctcaaggtggacttagagttt<br>taactggtgaagaagaggctcaagtttatgataactaa |
| PfNRS (ribosome<br>binding site is<br>underlined)<br>(SEQ ID NO: 215) | GGTACCAGTTGTTCTTATTGGTGGTGTTGCTTTAT<br>GGTTGCATCGTAGTAAATGGTTGTAACAAAAGC<br>AATTTTTCCGGCTGTCTGTATACAAAAACGCCGC<br>AAAGTTTGAGCGAAGTCAATAAACTCTCTACCC<br>ATTCAGGGCAATATCTCTCTTGGATCCAAAGTGA<br><u>ACTCTAGAAATAATTTTGTTTAACTTTAAGAAGG</u><br><u>AGATATACAT</u> |
| Ribosome binding site<br>and leader region (SEQ<br>ID NO: 216) | CTCTAGAAATAATTTTGTTTAACTTTAAGAAGGA<br>GATATACAT |

Example 18. Assessment of Intestinal Butyrate Levels in Response to SYN501 Administration in Mice To determine efficacy of butyrate production by the genetically engineered bacteria in vivo, the levels of butyrate upon administration of SYN501 (Logic156 (pSC101 PydfZ-ter→pbt-buk butyrate plasmid)) to C57BL6 mice was first assessed in the feces. Water containing 100 mM butyrate was used as a control.

On day 1, C57BL6 mice (24 total animals) were weighed and randomized into 4 groups; Group 1: H20 control (n=6); Group 2-100 mM butyrate (n=6); Group 3-streptomycin resistant Nissle (n=6); Group 4-SYN501 (n=6). Mice were either gavaged with 100 ul streptomycin resistant Nissle or SYN501, and group 2 was changed to H20(+)100 mM butyrate at a dose of 10e10 cells/100 ul. On days 2-4, mice were weighted and Groups 3 and 4 were gavaged in the AM and the PM with streptomycin resistant Nissle or SYN501. On day 5, mice were weighed and Groups 3 and 4 were gavaged in the am with streptomycin resistant Nissle or SYN501, and feces was collected and butyrate concentrations determined as described in Example 23. Results are depicted in FIG. 10. Significantly greater levels of butyrate were detected in the feces of the mice gavaged with SYN501 as compared mice gavaged with the Nissle control or those given water only. Levels are close to 2 mM and higher than the levels seen in the mice fed with H20 (+) 200 mM butyrate.

Next the effects of SYN501 on levels of butyrate in the cecum, cecal effluent, large intestine, and large intestine effluent are assessed. Because baseline concentrations of butyrate are high in these compartments, an antibiotic treatment is administered in advance to clear out the bacteria responsible for butyrate production in the intestine. As a result, smaller differences in butyrate levels can be more accurately observed and measured. Water containing 100 mM butyrate is used as a control.

During week 1 of the study, animals are treated with an antibiotic cocktail in the drinking water to reduce the baseline levels of resident microflora. The antibiotic cocktail is composed of ABX-ampicillin, vancomycin, neomycin, and metronidazole. During week 2 animals are orally administered 100 ul of streptomycin resistant Nissle or engineered strain SYN501 twice a day for five days (at a dose of 10e10 cells/100 ul).

On day 1, C57BL6 (Female, 8 weeks) are separated into four groups as follows: Group 1: H20 control (n=10); Group 2: 100 mM butyrate (n=10); Group 3: streptomycin resistant Nissle (n=10); Group 4: SYN501 (n=10). Animals are weighed and feces is collected from the animals (T=0-time point). Animals are changed to H2O (+) antibiotic cocktail. On day 5, animals are weighed and feces is collected (time point T=5 d). The H2O (+) antibiotic cocktail bottles are changed. On day 8, the mice are weighed and feces is collected. Mice of Group 3 and Group 4 are gavaged in the AM and PM with streptomycin resistant Nissle or SYN501. The water in all cages is changed to water without antibiotic. Group 2 is provided with 100 mM butyrate in H2O. On days 9-11, mice are weighed, and mice of Group 3 and Group 4 are gavaged in the AM and PM with streptomycin resistant Nissle or SYN501. On day 12, mice are gavaged with streptomycin resistant Nissle or SYN501 in the AM, and 4 hours post dose, blood is harvested, and cecal and large intestinal contents, and tissue, and feces are collected and processed for analysis.

Example 19. Measurement of Satiety Markers Upon Administration of SYN501 In Vivo To determine whether administration of a butyrate producing strain might result in increased levels of satiety markers, SYN501 is administered to 10-week old C57BL6 (10 weeks) and blood levels of GLP1 and insulin are measured. Butyrate in H20 at 100 mM is used as a control (e.g., as described in Lin et al., Butyrate and Propionate Protect against Diet-Induced Obesity and Regulate Gut Hormones via Free Fatty Acid Receptor 3-Independent Mechanisms, PLOS One, April 2012|Volume 7|Issue 4|e35240).

On day 1, animals are randomized and distributed into 5 groups as follows: Group 1: Time 0 control (n=6); Group 2-H20 (+) 100 mM butyrate, 10 min (n=6); Group 3-SYN501, 30 min (n=6); Group 4-SYN501, 4 h (n=6); Group 5-H20 (+) 100 mM butyrate, 4 h (n=6). Mice are fasted overnight. On day 2, mice are gavaged with either H20(+)100 mM butyrate or SYN501. Then, blood is harvested via cardiac bleed at the following time points post dose: Group 1 is Time 0; Group 2 (H20 (+) 100 mM butyrate) at 10 min; Group 3 (SYN501) at 30 min; Group 4 (SYN501) at 4 h; Group 5 (H20 (+) 100 mM butyrate) at 4 h. Serum is analyzed by ELISA for GLP-1 and insulin. Fecal samples are analyzed for butyrate by MS as described herein.

Example 20. Comparison of Butyrate Production Levels Between the Genetically Engineered Bacteria Encoding a Butyrate Cassette and Selected *Clostridia* Strains The efficacy of pbutyrate production in SYN501 (pSC101 PydfZ-ter→pbt-buk butyrate plasmid) was compared to CBM588 (*Clostridia butyricum* MIYARISAN, a Japanese probiotic strain), *Clostridium tyrobutyricum* VPI 5392 (Type Strain), and *Clostridium butyricum* NCTC 7423 (Type Strain).

Figure 12:
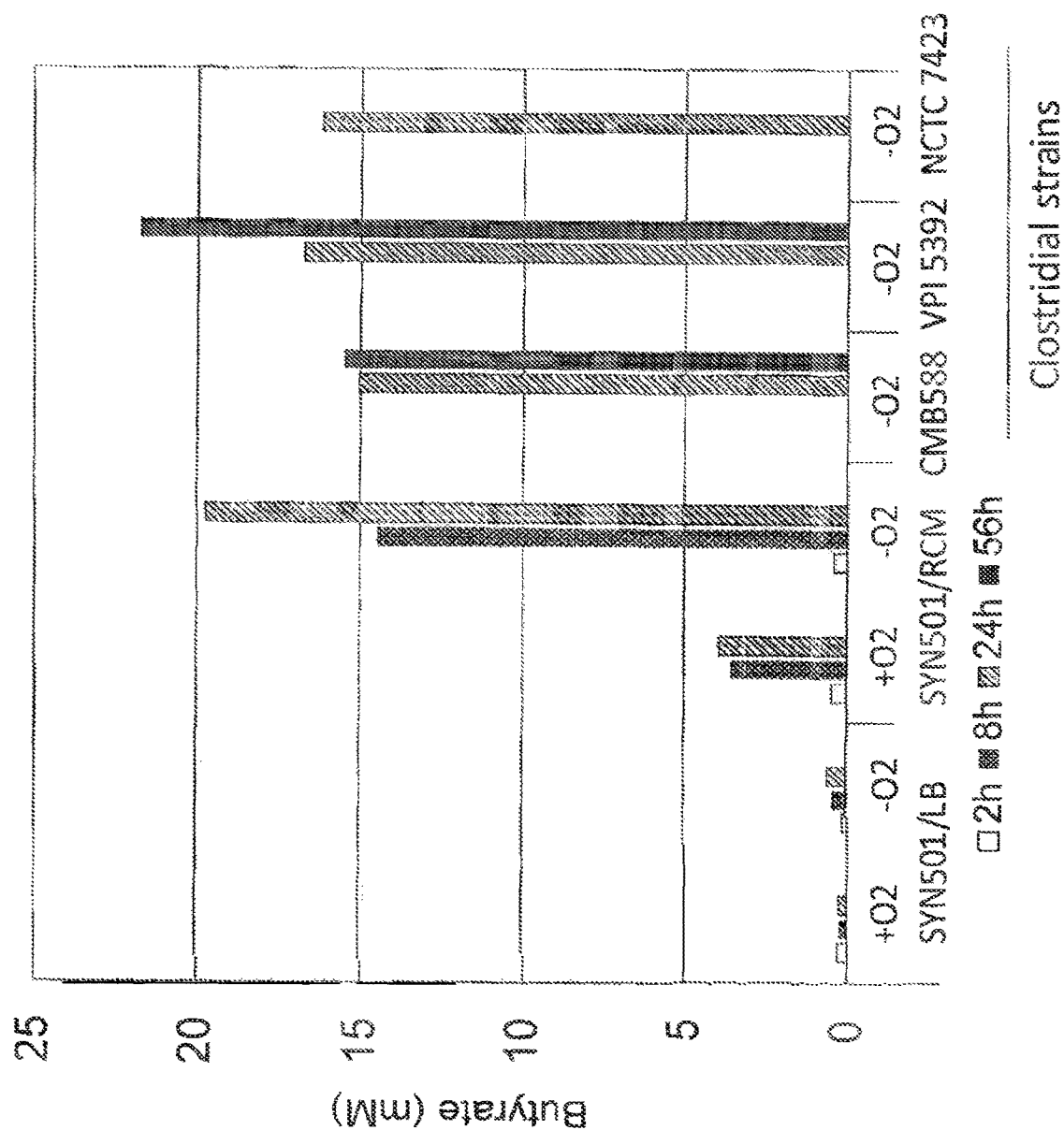
FIG. 12 depicts a bar graph comparing butyrate concentrations produced in vitro by the butyrate cassette plasmid strain SYN501 as compared to *Clostridia butyricum* MIYARISAN (a Japanese probiotic strain), *Clostridium tyrobutyricum* VPI 5392 (Type Strain), and *Clostridium butyricum* NCTC 7423 (Type Strain) under aerobic and anaerobic conditions at the indicated timepoints. The Nissle strain comprising the butyrate cassette produces butyrate levels comparable to *Clostridium* spp. in RCM media.
Figure 13A:
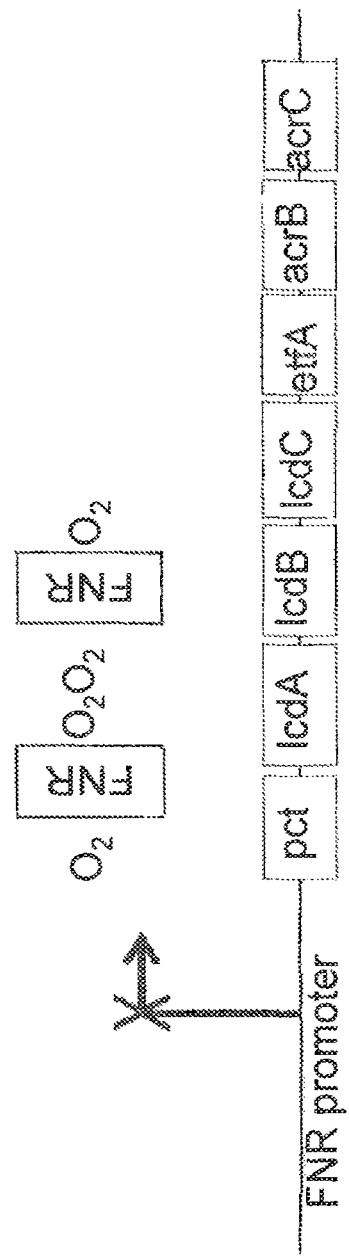
FIG. 13A depicts relatively low propionate production under aerobic conditions in which oxygen ($O_2$) prevents (indicated by "X") FNR (grey boxed "FNR") from dimerizing and activating the FNR-responsive promoter ("FNR promoter"). Therefore, none of the propionate biosynthesis enzymes (pct, lcdA, lcdB, lcdC, etfA, acrB, acrC; black boxes) are expressed.
Figure 13B:
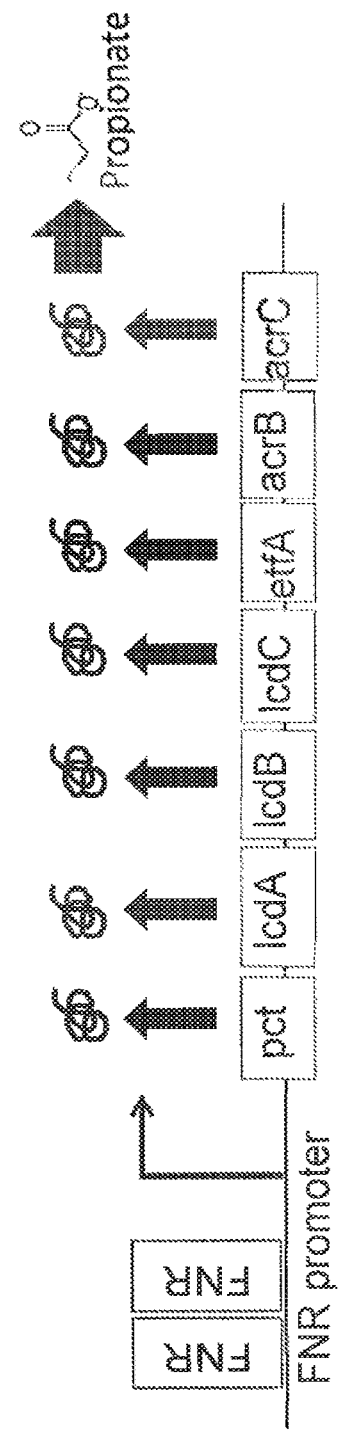
FIG. 13B depicts increased propionate production under low-oxygen conditions due to FNR dimerizing (two grey boxed "FNR"s), binding to the FNR-responsive promoter, and inducing expression of the propionate biosynthesis enzymes, which leads to the production of propionate.
Figure 14:
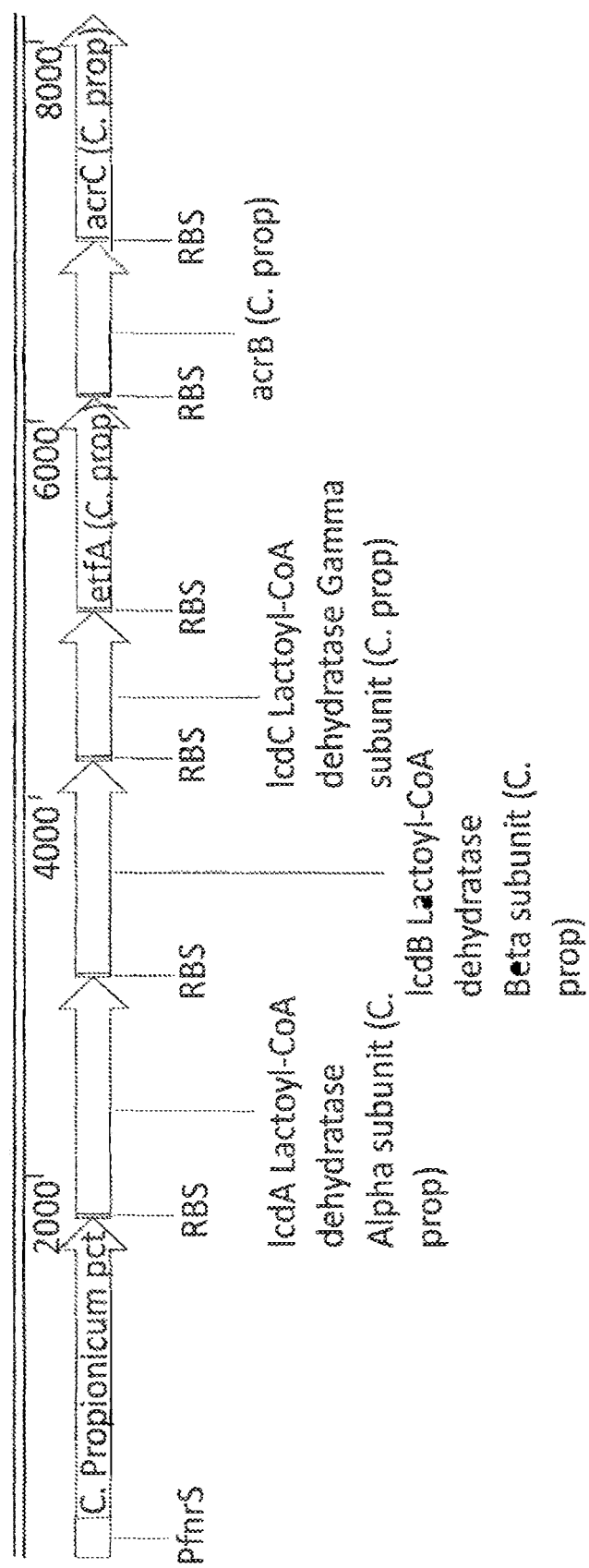
FIG. 14 depicts an exemplary propionate biosynthesis gene cassette.
Figure 15A:
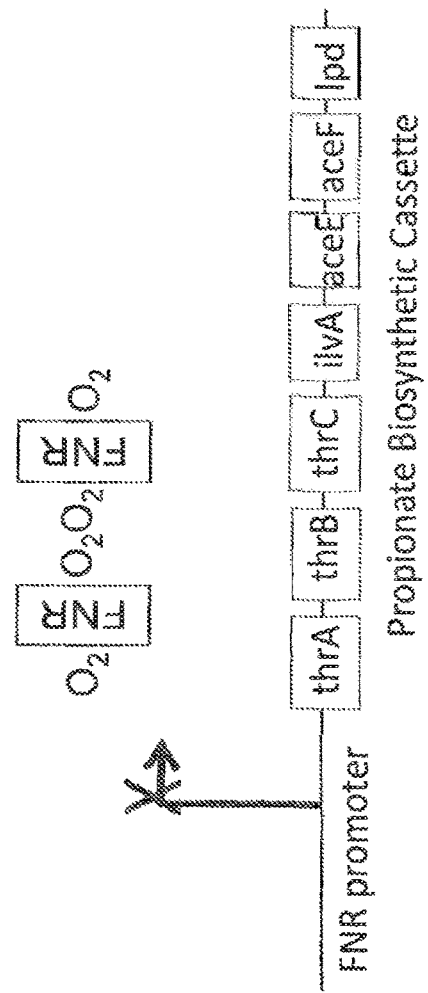
FIGS. 15A, 15B and 15C depict the gene organization of an exemplary engineered bacterium and its induction under low-oxygen conditions for the production of propionate.
Figure 15B:
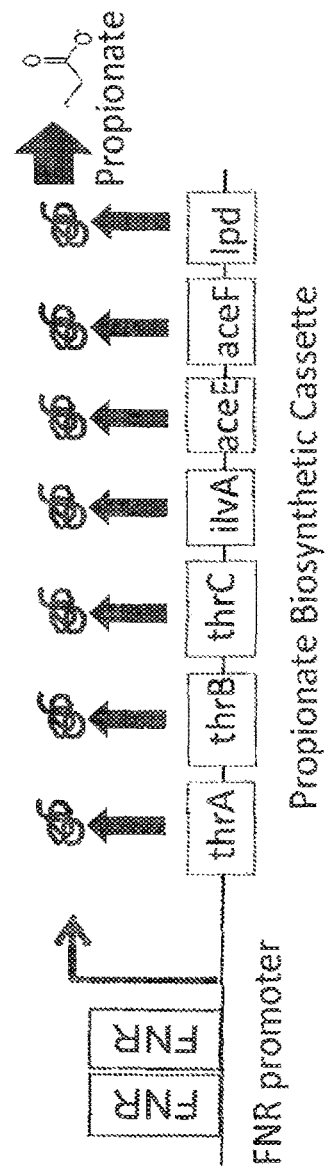
Figure 15C:
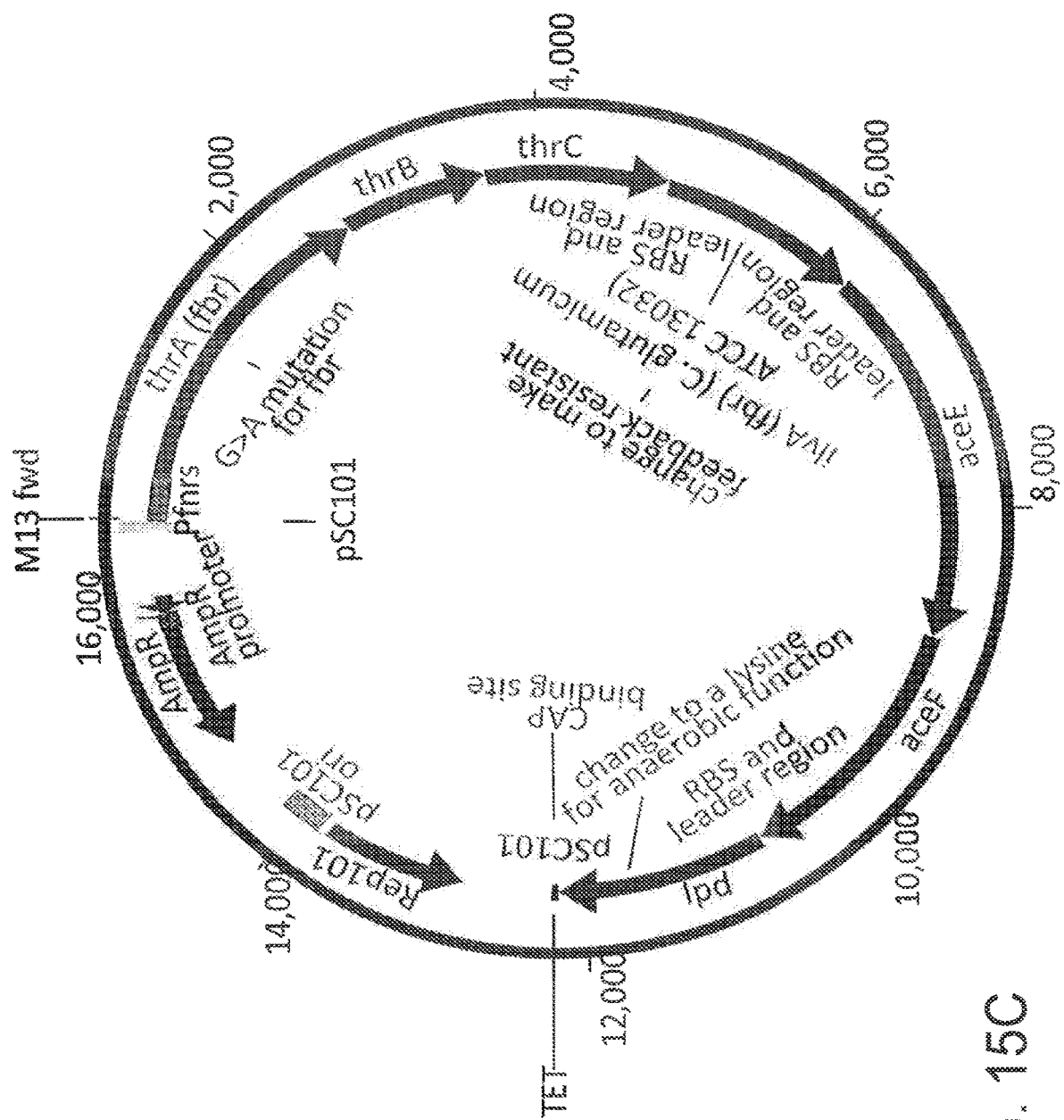
Figure 16A:
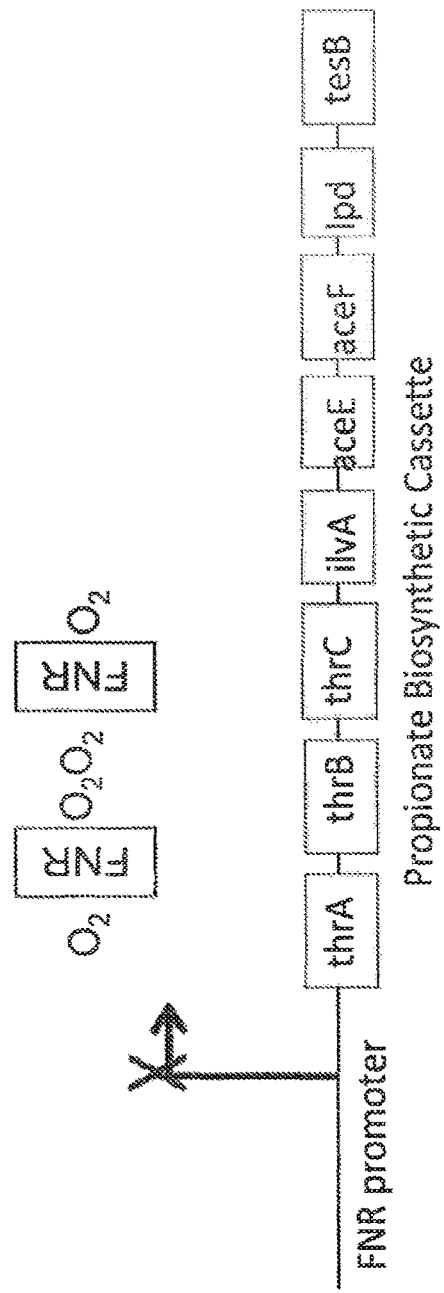
Figure 16B:
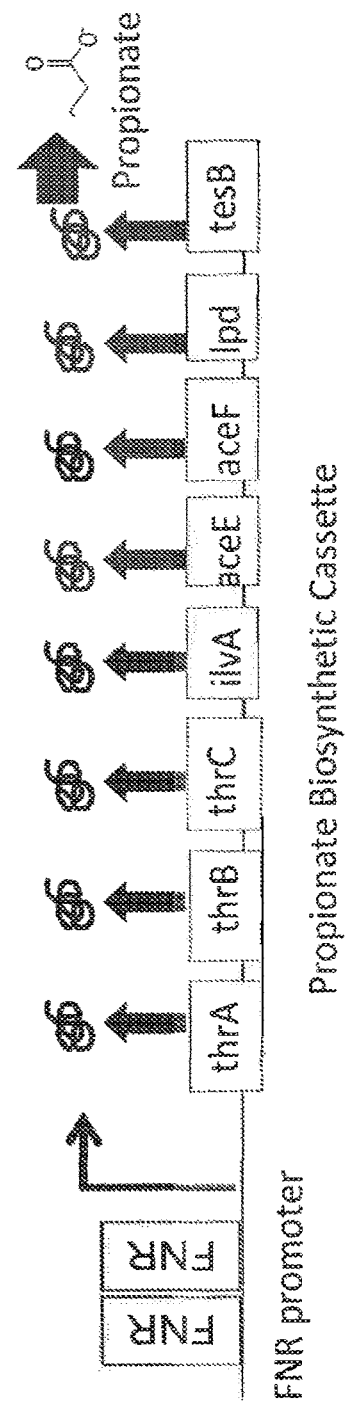

Briefly, overnight cultures of SYN501 were diluted 1:100 dilution and was grown in RCM (Reinforced Clostridial Media, which is similar to LB but contains 05% glucose) at 37 C with shaking for 2 hours, then either moved into the anaerobic chamber or left aerobically shaking. Clostridial strains were only grown anaerobically. At indicated times (2, 8, 24, and 48 h), 120 ul cells were removed and pelleted at 14,000 rpm for 1 min, and 100 ul of the supernatant was transferred to a 96-well assay plate and sealed with aluminum foil, and stored at −80 C until analysis by LC-MS for butyrate concentrations (as described in Example 22). Results are depicted in FIG. 12, and show that SYN501 produces butyrate levels comparable to *Clostridium* spp. in RCM media Example 22. Quantification of Butyrate by LC-MS/MS To obtain the butyrate measurements in Example 37 a LC-MS/MS protocol for butyrate quantification was used.
Sample Preparation First, fresh 1000, 500, 250, 100, 20, 4 and 0.8 µg/mL sodium butyrate standards were prepared in water. Then, 10 µL of sample (bacterial supernatants and standards) were pipetted into a V-bottom polypropylene 96-well plate, and 90 µL of 67% ACN (60 uL ACN+30 uL water per reaction) with 4 ug/mL of butyrate-d7 (CDN isotope) internal standard in final solution were added to each sample. The plate was heat-sealed, mixed well, and centrifuged at 4000 rpm for 5 minutes. In a round-bottom 96-well polypropylene plate, 20 µL of diluted samples were added to 180 µL of a buffer containing 10 mM MES pH4.5, 20 mM EDC (N-(3-Dimethylaminopropyl)-N'-ethylcarbodiimide), and 20 mM TFEA (2,2,2-trifluroethylamine). The plate was again heat-sealed and mixed well, and samples were incubated at room temperature for 1 hour.
LC-MS/MS Method Butyrate was measured by liquid chromatography coupled to tandem mass spectrometry (LC-MS/MS) using a Thermo TSQ Quantum Max triple quadrupole mass spectrometer. HPLC Details are listed in Table 40 and Table 41. Tandem Mass Spectrometry details are found in Table 42.

TABLE 40

| HPLC Details | |
|---|---|
| Column | Thermo Aquasil C18 column, 5 µm (50 × 2.1 mm) |
| Mobile Phase A | 100% H2O, 0.1% Formic Acid |
| Mobile Phase B | 100% ACN, 0.1% Formic Acid |
| Injection volume | 10 uL |

TABLE 41

| HPLC Method | | | |
|---|---|---|---|
| Total Time (min) | Flow Rate (µL/min) | A % | B % |
| 0 | 0.5 | 100 | 0 |
| 1 | 0.5 | 100 | 0 |
| 2 | 0.5 | 10 | 90 |
| 4 | 0.5 | 10 | 90 |
| 4.01 | 0.5 | 100 | 0 |
| 4.25 | 0.5 | 100 | 0 |

TABLE 42

| Tandem Mass Spectrometry Details | |
|---|---|
| Ion Source | HESI-II |
| Polarity | Positive |
| SRM transitions | Butyrate 170.0/71.1, Butyrate d7 177.1/78.3 |

Example 23. Quantification of Butyrate in Feces by LC-MS/MS

Sample Preparation

Fresh 1000, 500, 250, 100, 20, 4 and 0.8 µg/mL sodium butyrate standards were prepared in water. Single fecal pellets were ground in 100 uL water and centrifuged at 15,000 rpm for 5 min at 4° C. 10 µL of the sample (fecal supernatant and standards) were pipetted into a V-bottom polypropylene 96-well plate, and 90 µL of the derivatizing solution containing 50 mM of 2-Hydrazinoquinoline (2-HQ), dipyridyl disulfide, and triphenylphospine in acetonitrile with 5 ug/mL of butyrate-d$_7$ were added to each sample. The plate was heat-sealed and incubated at 60° C. for 1 hr. The plate was then centrifuged at 4,000 rpm for 5 min and 20 µL of the derivatized samples mixed to 180 µL of 22% acetonitrile with 0.1% formic acid. LC-MS/MS method Butyrate was measured by liquid chromatography coupled to tandem mass spectrometry (LC-MS/MS) using a Thermo TSQ Quantum Max triple quadrupole mass spectrometer. HPLC Details are listed in Table 43 and Table 43. Tandem Mass Spectrometry details are found in Table 43.

TABLE 43

HPLC Details

| Column | Luna phenomenex C18 column, 5 µm (100 × 2.1 mm) |
|---|---|
| Mobile Phase A | 100% H2O, 0.1% Formic Acid |
| Mobile Phase B | 100% ACN, 0.1% Formic Acid |
| Injection volume | 10 uL |

HPLC Method

| Total Time (min) | Flow Rate (µL/min) | A % | B % |
|---|---|---|---|
| 0 | 0.5 | 95 | 5 |
| 0.5 | 0.5 | 95 | 5 |
| 1.5 | 0.5 | 10 | 90 |
| 3.5 | 0.5 | 10 | 90 |
| 3.51 | 0.5 | 95 | 5 |
| 3.75 | 0.5 | 95 | 5 |

TABLE 44

Tandem Mass Spectrometry Details

| Ion Source | HESI-II |
|---|---|
| Polarity | Positive |
| SRM transitions | Butyrate 230.1/143.1, Butyrate d7 237.1/143.1 |

Example 24. Production of Propionate Through the Sleeping Beauty Mutase Pathway in Genetically Engineered E. coli BW25113 and Nissle In E. coli, a four gene operon, sbm-ygfD-ygfG-ygfH (sleeping beauty mutase pathway) has been shown to encode a putative cobalamin-dependent pathway with the ability to produce propionate from succinate in vitro. While the sleeping beauty mutase pathway is present in E. coli, it is not under the control of a strong promoter and has shown low activity in vivo.

The utility of this operon for the production of propionate was assessed. Because E. coli Nissle does not have the complete operon, initial experiments were conducted in E. coli K12 (BW25113).

First, the native promoter for the sleeping beauty mutase operon on the chromosome in the BW25113 strain was replaced with a fnr promoter (BW25113 ldhA::frt; PfnrS-SBM-cam). The sequence for this construct is provided in Table 45. Mutation of the lactate dehydrogenase gene (ldhA) reportedly increases propionate production, and this mutation is therefore also added in certain embodiments.

TABLE 45

SBM Construct Sequences

| Description | Sequence |
|---|---|
| BW25113 fnrS SBM construct (BW25113 frt-cam-frt-PfnrS-sbm, ygfD, ygfG, ygfH), comprising rrnB terminator 1, rrnB terminator 2 (both italic, uppercase), cat promoter and cam resistance gene (encoded on the lagging strand underlined uppercase), frt sites (italic underlined), FNRS promoter bold lowercase, with RBS and leader region bold and underlined and FNR binding site in bold and italics); sleeping beauty operon (sbm, ygfD, ygfG, ygfH) bold and uppercase (SEQ ID NO: 217) | *CAAATAAAACGAAAGGCTCAGTCGAAAGACTG GGCCTTTCGTTTTATCTGTTGTTGTCGGTGA ACGCTCTCCTGAGTAGGACAAATCCGCCGGG* AGCGGATTTGAACGTTGCGAAGCAACGGC CCGGAGGGTGGCGGGCAGGACGCCCGCC ATAAACTGCCAGGCATCAAATTAAGCAGAA GGCCATCCTGACGGATGGCCTTTTTGCGTGG CCAGTGCCAAGCTTGCATGCAGATTGCAG CATTACACGTCTTGAGCGATTGTGTAGGCT GGAGCTGCTTC*GAAGTTCCTATACTTTCTAG AGAATAGGAACTT*CGGAATAGGACTTCATTT AAATGGCGCGCCTTACGCCCCGCCCTGCC ACTCATCGCAGTACTGTTGTATTCATTAAG CATCTGCCGACATGGAAGCCATCACAAAC GGCATGATGAACCTGAATCGCCAGCGGCA TCAGCACCTTGTCGCCTTGCGTATAATATT TGCCCATGGTGAAAACGGGGGCGAAGAAG TTGTCCATATTGGCCACGTTTAAATCAAAA CTGGTGAAACTCACCCAGGGATTGGCTGA GACGAAAAACATATTCTCAATAAACCCTTT AGGGAAATAGGCCAGGTTTTCACCGTAAC ACGCCACATCTTGCGAATATATGTGTAGAA ACTGCCGGAAATCGTCGTGGTATTCACTC CAGAGCGATGAAAACGTTTCAGTTTGCTC ATGGAAAACGGTGTAACAAGGGTGAACAC TATCCCATATCACCAGCTCACCGTCTTTCA TTGCCATACGTAATTCCGGATGAGCATTCA TCAGGCGGGCAAGAATGTGAATAAAGGCC GGATAAAACTTGTGCTTATTTTTCTTTACG GTCTTTAAAAAGGCCGTAATATCCAGCTGA ACGGTCTGGTTATAGGTACATTGAGCAAC TGACTGAAATGCCTCAAAATGTTCTTTACG ATGCCATTGGGATATATCAACGGTGGTAT ATCCAGTGATTTTTTTCTCCATTTTAGCTT CCTTAGCTCCTGAAAATCTCGACAACTCAA AAAATACGCCCGGTAGTGATCTTATTTCAT |

TABLE 45-continued

SBM Construct Sequences

| Description | Sequence |
|---|---|
| | <u>TATGGTGAAAGTTGGAACCTCTTACGTGC</u> |
| | <u>CGATCAACGTCTCATTTTCGCCAAAAGTTG</u> |
| | <u>GCCCAGGGCTTCCCGGTATCAACAGGGAC</u> |
| | <u>ACCAGGATTTATTTATTCTGCGAAGTGATC</u> |
| | <u>TTCCGTCACAGGTAGGCGCGCC</u>*GAAGTTCC* |
| | *TATACTTTCTAGAGAATAGGAACTTC*GGAATA |
| | GGAACTAAGGAGGATATTCATATGGACCA |
| | TGGCTAATTCCCAGGTACCagttgttcttattggtggt |
| | gttgctttatggttgcatcgtagtaaatggttgtaacaaaagcaattttt |
| | ccggctgtctgtatacaaaaacgccgcaaagt*ttgagcgaagtcaa*ta |
| | aactactacccattcagggcaatatactcttggatccaaagtgaa<u>ct</u> |
| | <u>ctagaaataattttgtttaactttaagaaggagatatacat</u>ATGTC |
| | TAACGTGCAGGAGTGGCAACAGCTTGCCA |
| | ACAAGGAATTGAGCCGTCGGGAGAAAACT |
| | GTCGACTCGCTGGTTCATCAAACCGCGGA |
| | AGGGATCGCCATCAAGCCGCTGTATACCG |
| | AAGCCGATCTCGATAATCTGGAGGTGACA |
| | GGTACCCTTCCTGGTTTGCCGCCCTACGTT |
| | CGTGGCCCGCGTGCCACTATGTATACCGC |
| | CCAACCGTGGACCATCCGTCAGTATGCTG |
| | GTTTTTCAACAGCAAAAGAGTCCAACGCTT |
| | TTTATCGCCGTAACCTGGCCGCCGGGCAA |
| | AAAGGTCTTTCCGTTGCGTTTGACCTTGCC |
| | ACCCACCGTGGCTACGACTCCGATAACCC |
| | GCGCGTGGCGGGCGACGTCGGCAAAGCG |
| | GGCGTCGCTATCGACACCGTGGAAGATAT |
| | GAAAGTCCTGTTCGACCAGATCCCGCTGG |
| | ATAAAATGTCGGTTTCGATGACCATGAATG |
| | GCGCAGTGCTACCAGTACTGGCGTTTTAT |
| | ATCGTCGCCGCAGAAGAGCAAGGTGTTAC |
| | ACCTGATAAACTGACCGGCACCATTCAAA |
| | ACGATATTCTCAAAGAGTACCTCTGCCGCA |
| | ACACCTATATTTACCCACCAAAACCGTCAA |
| | TGCGCATTATCGCCGACATCATCGCCTGG |
| | TGTTCCGGCAACATGCCGCGATTTAATACC |
| | ATCAGTATCAGCGGTTACCACATGGGTGA |
| | AGCGGGTGCCAACTGCGTGCAGCAGGTAG |
| | CATTTACGCTCGCTGATGGGATTGAGTAC |
| | ATCAAAGCAGCAATCTCTGCCGGACTGAA |
| | AATTGATGACTTCGCTCCTCGCCTGTCGTT |
| | CTTCTTCGGCATCGGCATGGATCTGTTTAT |
| | GAACGTCGCCATGTTGCGTGCGGCACGTT |
| | ATTTATGGAGCGAAGCGGTCAGTGGATTT |
| | GGCGCACAGGACCCGAAATCACTGGCGCT |
| | GCGTACCCACTGCCAGACCTCAGGCTGGA |
| | GCCTGACTGAACAGGATCCGTATAACAAC |
| | GTTATCCGCACCACCATTGAAGCGCTGGC |
| | TGCGACGCTGGGCGGTACTCAGTCACTGC |
| | ATACCAACGCCTTTGACGAAGCGCTTGGT |
| | TTGCCTACCGATTTCTCAGCACGCATTGCC |
| | CGCAACACCCAGATCATCATCCAGGAAGA |
| | ATCAGAACTCTGCCGCACCGTCGATCCAC |
| | TGGCCGGATCCTATTACATTGAGTCGCTG |
| | ACCGATCAAATCGTCAAACAAGCCAGAGC |
| | TATTATCCAACAGATCGACGAAGCCGGTG |
| | GCATGGCGAAAGCGATCGAAGCAGGTCTG |
| | CCAAAACGAATGATCGAAGAGGCCTCAGC |
| | GCGCGAACAGTCGCTGATCGACCAGGGCA |
| | AGCGTGTCATCGTTGGTGTCAACAAGTAC |
| | AAACTGGATCACGAAGACGAAACCGATGT |
| | ACTTGAGATCGACAACGTGATGGTGCGTA |
| | ACGAGCAAATTGCTTCGCTGGAACGCATT |
| | CGCGCCACCCGTGATGATGCCGCGTAAC |
| | CGCCGCGTTGAACGCCCTGACTCACGCCG |
| | CACAGCATAACGAAAACCTGCTGGCTGCC |
| | GCTGTTAATGCCGCTCGCGTTCGCGCCAC |
| | CCTGGGTGAAATTTCCGATGCGCTGGAAG |
| | TCGCTTTCGACCGTTATCTGGTGCCAAGCC |
| | AGTGTGTTACCGGCGTGATTGCGCAAAGC |
| | TATCATCAGTCTGAGAAATCGGCCTCCGA |
| | GTTCGATGCCATTGTTGCGCAAACGGAGC |
| | AGTTCCTTGCCGACAATGGTCGTCGCCCG |
| | CGCATTCTGATCGCTAAGATGGGCCAGGA |
| | TGGACACGATCGCGGCGCGAAAGTGATCG |
| | CCAGCGCCTATTCCGATCTCGGTTTCGAC |
| | GTAGATTTAAGCCCGATGTTCTCTACACCT |

TABLE 45-continued

SBM Construct Sequences

| Description | Sequence |
|---|---|
| | GAAGAGATCGCCCGCCTGGCCGTAGAAAA |
| | CGACGTTCACGTAGTGGGCGCATCCTCAC |
| | TGGCTGCCGGTCATAAAACGCTGATCCCG |
| | GAACTGGTCGAAGCGCTGAAAAAATGGGG |
| | ACGCGAAGATATCTGCGTGGTCGCGGGTG |
| | GCGTCATTCCGCCGCAGGATTACGCCTTC |
| | CTGCAAGAGCGCGGCGTGGCGGCGATTTA |
| | TGGTCCAGGTACACCTATGCTCGACAGTG |
| | TGCGCGACGTACTGAATCTGATAAGCCAG |
| | CATCATGATTAATGAAGCCACGCTGGCAG |
| | AAAGTATTCGCCGCTTACGTCAGGGTGAG |
| | CGTGCCACACTCGCCCAGGCCATGACGCT |
| | GGTGGAAAGCCGTCACCCGCGTCATCAGG |
| | CACTAAGTACGCAGCTGCTTGATGCCATTA |
| | TGCCGTACTGCGGTAACACCCTGCGACTG |
| | GGCGTTACCGGCACCCCCGGCGCGGGGAA |
| | AAGTACCTTTCTTGAGGCCTTTGGCATGTT |
| | GTTGATTCGAGAGGGATTAAAGGTCGCGG |
| | TTATTGCGGTCGATCCCAGCAGCCCGGTC |
| | ACTGGCGGTAGCATTCTCGGGGATAAAAC |
| | CCGCATGAATGACCTGGCGCGTGCCGAAG |
| | CGGCGTTTATTCGCCCGGTACCATCCTCC |
| | GGTCATCTGGGCGGTGCCAGTCAGCGAGC |
| | GCGGGAATTAATGCTGTTATGCGAAGCAG |
| | CGGGTTATGACGTAGTGATTGTCGAAACG |
| | GTTGGCGTCGGGCAGTCGGAAACAGAAGT |
| | CGCCCGCATGGTGGACTGTTTTATCTCGTT |
| | GCAAATTGCCGGTGGCGGCGATGATCTGC |
| | AGGGCATTAAAAAAGGGCTGATGGAAGTG |
| | GCTGATCTGATCGTTATCAACAAAGACGAT |
| | GGCGATAACCATACCAATGTCGCCATTGC |
| | CCGGCATATGTACGAGAGTGCCCTGCATA |
| | TTCTGCGACGTAAATACGACGAATGGCAG |
| | CCACGGGTTCTGACTTGTAGCGCACTGGA |
| | AAAACGTGGAATCGATGAGATCTGGCACG |
| | CCATCATCGACTTCAAAACCGCGCTAACTG |
| | CCAGTGGTCGTTTACAACAAGTGCGGCAA |
| | CAACAATCGGTGGAATGGCTGCGTAAGCA |
| | GACCGAAGAAGAAGTACTGAATCACCTGT |
| | TCGCGAATGAAGATTTCGATCGCTATTACC |
| | GCCAGACGCTTTTAGCGGTCAAAAACAAT |
| | ACGCTCTCACCGCGCACCGGCCTGCGGCA |
| | GCTCAGTGAATTTATCCAGACGCAATATTT |
| | TGATTAAAGGAATTTTTATGTCTTATCAGTA |
| | TGTTAACGTTGTCACTATCAACAAAGTGGC |
| | GGTCATTGAGTTTAACTATGGCCGAAAACT |
| | TAATGCCTTAAGTAAAGTCTTTATTGATGA |
| | TCTTATGCAGGCGTTAAGCGATCTCAACC |
| | GGCCGGAAATTCGCTGTATCATTTTGCGC |
| | GCACCGAGTGGATCCAAAGTCTTCTCCGC |
| | AGGTCACGATATTCACGAACTGCCGTCTG |
| | GCGGTCGCGATCCGCTCTCCTATGATGAT |
| | CCATTGCGTCAAATCACCCGCATGATCCAA |
| | AAATTCCCGAAACCGATCATTTCGATGGTG |
| | GAAGGTAGTGTTTGGGGTGGCGCATTTGA |
| | AATGATCATGAGTTCCGATCTGATCATCGC |
| | CGCCAGTACCTCAACCTTCTCAATGACGCC |
| | TGTAAACCTCGGCGTCCCGTATAACCTGG |
| | TCGGCATTCACAACCTGACCCGCGACGCG |
| | GGCTTCCACATTGTCAAAGAGCTGATTTTT |
| | ACCGCTTCGCCAATCACCGCCCAGCGCGC |
| | GCTGGCTGTCGGCATCCTCAACCATGTTG |
| | TGGAAGTGGAAGAACTGGAAGATTTCACC |
| | TTACAAATGGCGCACCACATCTCTGAGAA |
| | AGCGCCGTTAGCCATTGCCGTTATCAAAG |
| | AAGAGCTGCGTGTACTGGGCGAAGCACAC |
| | ACCATGAACTCCGATGAATTTGAACGTATT |
| | CAGGGGATGCCGCCGCGGTGTATGACAG |
| | CGAAGATTACCAGGAAGGGATGAACGCTT |
| | TCCTCGAAAAACGTAAACCTAATTTCGTTG |
| | GTCATTAATCCCTGCGAACGAAGGAGTAAA |
| | AATGGAAACTCAGTGGACAAGGATGACCG |
| | CCAATGAAGCGGCAGAAATTATCCAGCAT |
| | AACGACATGGTGGCATTTAGCGGCTTTAC |
| | CCCGGCGGGTTCGCCGAAAGCCCTACCCA |
| | CCGCGATTGCCCGCAGAGCTAACGAACAG |

TABLE 45-continued

SBM Construct Sequences

| Description | Sequence |
|---|---|
| | CATGAGGCCAAAAAGCCGTATCAAATTCG<br>CCTTCTGACGGGTGCGTCAATCAGCGCCG<br>CCGCTGACGATGTACTTTCTGACGCCGAT<br>GCTGTTTCCTGGCGTGCGCCATATCAAAC<br>ATCGTCCGGTTTACGTAAAAAGATCAATCA<br>GGGCGCGGTGAGTTTCGTTGACCTGCATT<br>TGAGCGAAGTGGCGCAAATGGTCAATTAC<br>GGTTTCTTCGGCGACATTGATGTTGCCGTC<br>ATTGAAGCATCGGCACTGGCACCGGATGG<br>TCGAGTCTGGTTAACCAGCGGGATCGGTA<br>ATGCGCCGACCTGGCTGCTGCGGGCGAAG<br>AAAGTGATCATTGAACTCAATCACTATCAC<br>GATCCGCGCGTTGCAGAACTGGCGGATAT<br>TGTGATTCCTGGCGCGCCACCGCGGCGCA<br>ATAGCGTGTCGATCTTCCATGCAATGGATC<br>GCGTCGGTACCCGCTATGTGCAAATCGAT<br>CCGAAAAAGATTGTCGCCGTCGTGGAAAC<br>CAACTTGCCCGACGCCGGTAATATGCTGG<br>ATAAGCAAAATCCCATGTGCCAGCAGATT<br>GCCGATAACGTGGTCACGTTCTTATTGCA<br>GGAAATGGCGCATGGGCGTATTCCGCCGG<br>AATTTCTGCCGCTGCAAAGTGGCGTGGGC<br>AATATCAATAATGCGGTAATGGCGCGTCT<br>GGGGGAAAACCCGGTAATTCCTCCGTTTA<br>TGATGTATTCGGAAGTGCTACAGGAATCG<br>GTGGTGCATTTACTGGAAACCGGCAAAAT<br>CAGCGGGGCCAGCGCCTCCAGCCTGACAA<br>TCTCGGCCGATTCCCTGCGCAAGATTTAC<br>GACAATATGGATTACTTTGCCAGCCGCATT<br>GTGTTGCGTCCGCAGGAGATTTCCAATAA<br>CCCGGAAATCATCCGTCGTCTGGGCGTCA<br>TCGCTCTGAACGTCGGCCTGGAGTTTGAT<br>ATTTACGGGCATGCCAACTCAACACACGT<br>AGCCGGGGTCGATCTGATGAACGGCATCG<br>GCGGCAGCGGTGATTTTGAACGCAACGCG<br>TATCTGTCGATCTTTATGGCCCCGTCGATT<br>GCTAAAGAAGGCAAGATCTCAACCGTCGT<br>GCCAATGTGCAGCCATGTTGATCACAGCG<br>AACACAGCGTCAAAGTGATCATCACCGAA<br>CAAGGGATCGCCGATCTGCGCGGTCTTTC<br>CCCGCTTCAACGCGCCCGCACTATCATTG<br>ATAATTGTGCACATCCTATGTATCGGGATT<br>ATCTGCATCGCTATCTGGAAAATGCGCCT<br>GGCGGACATATTCACCACGATCTTAGCCA<br>CGTCTTCGACTTACACCGTAATTTAATTGC<br>AACCGGCTCGATGCTGGGTTAA |
| FNRS promoter bold lowercase, with RBS and leader region bold and underlined, and FNR binding site bold and italics); sleeping beauty operon (sbm, ygfD, ygfG, ygfH) bold and uppercase<br>(SEQ ID NO: 218) | agttgttcttattggtggtgttgctttatggttgcatcgtagtaaatggtt<br>gtaacaaaagcaatttttccggctgtctgtatacaaaaacgccgcaaa<br>gttt*gagcgaagtcaat*aaactctctacccattcagggcaatatctctct<br>tggatccaaagtgaa<u>ctctagaaataattttgtttaactttaagaagga</u><br><u>gatatacat</u>ATGTCTAACGTGCAGGAGTGGCAA<br>CAGCTTGCCAACAAGGAATTGAGCCGTCG<br>GGAGAAAACTGTCGACTCGCTGGTTCATC<br>AAACCGCGGAAGGGATCGCCATCAAGCCG<br>CTGTATACCGAAGCCGATCTCGATAATCTG<br>GAGGTGACAGGTACCCTTCCTGGTTTGCC<br>GCCCTACGTTCGTGGCCCGCGTGCCACTA<br>TGTATACCGCCCAACCGTGGACCATCCGT<br>CAGTATGCTGGTTTTTCAACAGCAAAAGA<br>GTCCAACGCTTTTTATCGCCGTAACCTGGC<br>CGCCGGGCAAAAAGGTCTTTCCGTTGCGT<br>TTGACCTTGCCACCCACCGTGGCTACGAC<br>TCCGATAACCCGCGCGTGGCGGGCGACGT<br>CGGCAAAGCGGGCGTCGCTATCGACACCG<br>TGGAAGATATGAAAGTCCTGTTCGACCAG<br>ATCCCGCTGGATAAAATGTCGGTTTCGAT<br>GACCATGAATGGCGCAGTGCTACCAGTAC<br>TGGCGTTTTATATCGTCGCCGCAGAAGAG<br>CAAGGTGTTACACCTGATAAACTGACCGG<br>CACCATTCAAAACGATATTCTCAAAGAGTA<br>CCTCTGCCGCAACACCTATATTTACCCACC<br>AAAACCGTCAATGCGCATTATCGCCGACA<br>TCATCGCCTGGTGTTCCGGCAACATGCCG<br>CGATTTAATACCATCAGTATCAGCGGTTAC<br>CACATGGGTGAAGCGGGTGCCAACTGCGT |

TABLE 45-continued

SBM Construct Sequences

| Description | Sequence |
|---|---|
| | GCAGCAGGTAGCATTTACGCTCGCTGATG |
| | GGATTGAGTACATCAAAGCAGCAATCTCT |
| | GCCGGACTGAAAATTGATGACTTCGCTCC |
| | TCGCCTGTCGTTCTTCTTCGGCATCGGCAT |
| | GGATCTGTTTATGAACGTCGCCATGTTGC |
| | GTGCGGCACGTTATTTATGGAGCGAAGCG |
| | GTCAGTGGATTTGGCGCACAGGACCCGAA |
| | ATCACTGGCGCTGCGTACCCACTGCCAGA |
| | CCTCAGGCTGGAGCCTGACTGAACAGGAT |
| | CCGTATAACAACGTTATCCGCACCACCATT |
| | GAAGCGCTGGCTGCGACGCTGGGCGGTAC |
| | TCAGTCACTGCATACCAACGCCTTTGACGA |
| | AGCGCTTGGTTTGCCTACCGATTTCTCAGC |
| | ACGCATTGCCCGCAACACCCAGATCATCA |
| | TCCAGGAAGAATCAGAACTCTGCCGCACC |
| | GTCGATCCACTGGCCGGATCCTATTACATT |
| | GAGTCGCTGACCGATCAAATCGTCAAACA |
| | AGCCAGAGCTATTATCCAACAGATCGACG |
| | AAGCCGGTGGCATGGCGAAAGCGATCGAA |
| | GCAGGTCTGCCAAAACGAATGATCGAAGA |
| | GGCCTCAGCGCGCGAACAGTCGCTGATCG |
| | ACCAGGGCAAGCGTGTCATCGTTGGTGTC |
| | AACAAGTACAAACTGGATCACGAAGACGA |
| | AACCGATGTACTTGAGATCGACAACGTGA |
| | TGGTGCGTAACGAGCAAATTGCTTCGCTG |
| | GAACGCATTCGCGCCACCCGTGATGATGC |
| | CGCCGTAACCGCCGCGTTGAACGCCCTGA |
| | CTCACGCCGCACAGCATAACGAAAACCTG |
| | CTGGCTGCCGCTGTTAATGCCGCTCGCGT |
| | TCGCGCCACCCTGGGTGAAATTTCCGATG |
| | CGCTGGAAGTCGCTTTCGACCGTTATCTG |
| | GTGCCAAGCCAGTGTGTTACCGGCGTGAT |
| | TGCGCAAAGCTATCATCAGTCTGAGAAAT |
| | CGGCCTCCGAGTTCGATGCCATTGTTGCG |
| | CAAACGGAGCAGTTCCTTGCCGACAATGG |
| | TCGTCGCCCGCGCATTCTGATCGCTAAGA |
| | TGGGCCAGGATGGACACGATCGCGGCGCG |
| | AAAGTGATCGCCAGCGCCTATTCCGATCT |
| | CGGTTTCGACGTAGATTTAAGCCCGATGTT |
| | CTCTACACCTGAAGAGATCGCCCGCCTGG |
| | CCGTAGAAAACGACGTTCACGTAGTGGGC |
| | GCATCCTCACTGGCTGCCGGTCATAAAAC |
| | GCTGATCCCGGAACTGGTCGAAGCGCTGA |
| | AAAAATGGGGACGCGAAGATATCTGCGTG |
| | GTCGCGGGTGGCGTCATTCCGCCGCAGGA |
| | TTACGCCTTCCTGCAAGAGCGCGGCGTGG |
| | CGGCGATTTATGGTCCAGGTACACCTATG |
| | CTCGACAGTGTGCGCGACGTACTGAATCT |
| | GATAAGCCAGCATCATGATTAATGAAGCC |
| | ACGCTGGCAGAAAGTATTCGCCGCTTACG |
| | TCAGGGTGAGCGTGCCACACTCGCCCAGG |
| | CCATGACGCTGGTGGAAAGCCGTCACCCG |
| | CGTCATCAGGCACTAAGTACGCAGCTGCT |
| | TGATGCCATTATGCCGTACTGCGGTAACA |
| | CCCTGCGACTGGGCGTTACCGGCACCCCC |
| | GGCGCGGGAAAAGTACCTTTCTTGAGGC |
| | CTTTGGCATGTTGTTGATTCGAGAGGGATT |
| | AAAGGTCGCGGTTATTGCGGTCGATCCCA |
| | GCAGCCCGGTCACTGGCGGTAGCATTCTC |
| | GGGGATAAAACCCGCATGAATGACCTGGC |
| | GCGTGCCGAAGCGGCGTTTATTCGCCCGG |
| | TACCATCCTCCGGTCATCTGGGCGGTGCC |
| | AGTCAGCGAGCGCGGGAATTAATGCTGTT |
| | ATGCGAAGCAGCGGGTTATGACGTAGTGA |
| | TTGTCGAAACGGTTGGCGTCGGGCAGTCG |
| | GAAACAGAAGTCGCCCGCATGGTGGACTG |
| | TTTTATCTCGTTGCAAATTGCCGGTGGCGG |
| | CGATGATCTGCAGGGCATTAAAAAAGGGC |
| | TGATGGAAGTGGCTGATCTGATCGTTATC |
| | AACAAAGACGATGGCGATAACCATACCAA |
| | TGTCGCCATTGCCCGGCATATGTACGAGA |
| | GTGCCCTGCATATTCTGCGACGTAAATAC |
| | GACGAATGGCAGCCACGGGTTCTGACTTG |
| | TAGCGCACTGGAAAAACGTGGAATCGATG |
| | AGATCTGGCACGCCATCATCGACTTCAAA |
| | ACCGCGCTAACTGCCAGTGGTCGTTTACA |

TABLE 45-continued

SBM Construct Sequences

| Description | Sequence |
|---|---|
| | ACAAGTGCGGCAACAACAATCGGTGGAAT |
| | GGCTGCGTAAGCAGACCGAAGAAGAAGTA |
| | CTGAATCACCTGTTCGCGAATGAAGATTTC |
| | GATCGCTATTACCGCCAGACGCTTTTAGC |
| | GGTCAAAAACAATACGCTCTCACCGCGCA |
| | CCGGCCTGCGGCAGCTCAGTGAATTTATC |
| | CAGACGCAATATTTTGATTAAAGGAATTTT |
| | TATGTCTTATCAGTATGTTAACGTTGTCAC |
| | TATCAACAAAGTGGCGGTCATTGAGTTTAA |
| | CTATGGCCGAAAACTTAATGCCTTAAGTAA |
| | AGTCTTTATTGATGATCTTATGCAGGCGTT |
| | AAGCGATCTCAACCGGCCGGAAATTCGCT |
| | GTATCATTTTGCGCGCACCGAGTGGATCC |
| | AAAGTCTTCTCCGCAGGTCACGATATTCAC |
| | GAACTGCCGTCTGGCGGTCGCGATCCGCT |
| | CTCCTATGATGATCCATTGCGTCAAATCAC |
| | CCGCATGATCCAAAAATTCCCGAAACCGA |
| | TCATTTCGATGGTGGAAGGTAGTGTTTGG |
| | GGTGGCGCATTTGAAATGATCATGAGTTC |
| | CGATCTGATCATCGCCGCCAGTACCTCAA |
| | CCTTCTCAATGACGCCTGTAAACCTCGGC |
| | GTCCCGTATAACCTGGTCGGCATTCACAA |
| | CCTGACCCGCGACGCGGGCTTCCACATTG |
| | TCAAAGAGCTGATTTTTACCGCTTCGCCAA |
| | TCACCGCCCAGCGCGCGCTGGCTGTCGGC |
| | ATCCTCAACCATGTTGTGGAAGTGGAAGA |
| | ACTGGAAGATTTCACCTTACAAATGGCGC |
| | ACCACATCTCTGAGAAAGCGCCGTTAGCC |
| | ATTGCCGTTATCAAAGAAGAGCTGCGTGT |
| | ACTGGGCGAAGCACACACCATGAACTCCG |
| | ATGAATTTGAACGTATTCAGGGGATGCGC |
| | CGCGCGGTGTATGACAGCGAAGATTACCA |
| | GGAAGGGATGAACGCTTTCCTCGAAAAAC |
| | GTAAACCTAATTTCGTTGGTCATTAATCCC |
| | TGCGAACGAAGGAGTAAAAATGGAAACTCA |
| | GTGGACAAGGATGACCGCCAATGAAGCGG |
| | CAGAAATTATCCAGCATAACGACATGGTG |
| | GCATTTAGCGGCTTTACCCCGGCGGGTTC |
| | GCCGAAAGCCCTACCCACCGCGATTGCCC |
| | GCAGAGCTAACGAACAGCATGAGGCCAAA |
| | AAGCCGTATCAAATTCGCCTTCTGACGGG |
| | TGCGTCAATCAGCGCCGCCGCTGACGATG |
| | TACTTTCTGACGCCGATGCTGTTTCCTGGC |
| | GTGCGCCATATCAAACATCGTCCGGTTTAC |
| | GTAAAAAGATCAATCAGGGCGCGGTGAGT |
| | TTCGTTGACCTGCATTTGAGCGAAGTGGC |
| | GCAAATGGTCAATTACGGTTTCTTCGGCG |
| | ACATTGATGTTGCCGTCATTGAAGCATCG |
| | GCACTGGCACCGGATGGTCGAGTCTGGTT |
| | AACCAGCGGGATCGGTAATGCGCCGACCT |
| | GGCTGCTGCGGGCGAAGAAAGTGATCATT |
| | GAACTCAATCACTATCACGATCCGCGCGTT |
| | GCAGAACTGGCGGATATTGTGATTCCTGG |
| | CGCGCCACCGCGGCGCAATAGCGTGTCGA |
| | TCTTCCATGCAATGGATCGCGTCGGTACC |
| | CGCTATGTGCAAATCGATCCGAAAAAGAT |
| | TGTCGCCGTCGTGGAAACCAACTTGCCCG |
| | ACGCCGGTAATATGCTGGATAAGCAAAAT |
| | CCCATGTGCCAGCAGATTGCCGATAACGT |
| | GGTCACGTTCTTATTGCAGGAAATGGCGC |
| | ATGGGCGTATTCCGCCGGAATTTCTGCCG |
| | CTGCAAAGTGGCGTGGGCAATATCAATAA |
| | TGCGGTAATGGCGCGTCTGGGGGAAAACC |
| | CGGTAATTCCTCCGTTTATGATGTATTCGG |
| | AAGTGCTACAGGAATCGGTGGTGCATTTA |
| | CTGGAAACCGGCAAAATCAGCGGGGCCAG |
| | CGCCTCCAGCCTGACAATCTCGGCCGATT |
| | CCCTGCGCAAGATTTACGACAATATGGATT |
| | ACTTTGCCAGCCGCATTGTGTTGCGTCCG |
| | CAGGAGATTTCCAATAACCCGGAAATCAT |
| | CCGTCGTCTGGGCGTCATCGCTCTGAACG |
| | TCGGCCTGGAGTTTGATATTTACGGGCAT |
| | GCCAACTCAACACACGTAGCCGGGGTCGA |
| | TCTGATGAACGGCATCGGCGGCAGCGGTG |
| | ATTTTGAACGCAACGCGTATCTGTCGATCT |
| | TTATGGCCCCGTCGATTGCTAAAGAAGGC |

TABLE 45-continued

SBM Construct Sequences

| Description | Sequence |
|---|---|
| | AAGATCTCAACCGTCGTGCCAATGTGCAG<br>CCATGTTGATCACAGCGAACACAGCGTCA<br>AAGTGATCATCACCGAACAAGGGATCGCC<br>GATCTGCGCGGTCTTTCCCCGCTTCAACG<br>CGCCCGCACTATCATTGATAATTGTGCACA<br>TCCTATGTATCGGGATTATCTGCATCGCTA<br>TCTGGAAAATGCGCCTGGCGGACATATTC<br>ACCACGATCTTAGCCACGTCTTCGACTTAC<br>ACCGTAATTTAATTGCAACCGGCTCGATGC<br>TGGGTTAA |

Next, this strain was tested for propionate production.

Figure 20A:
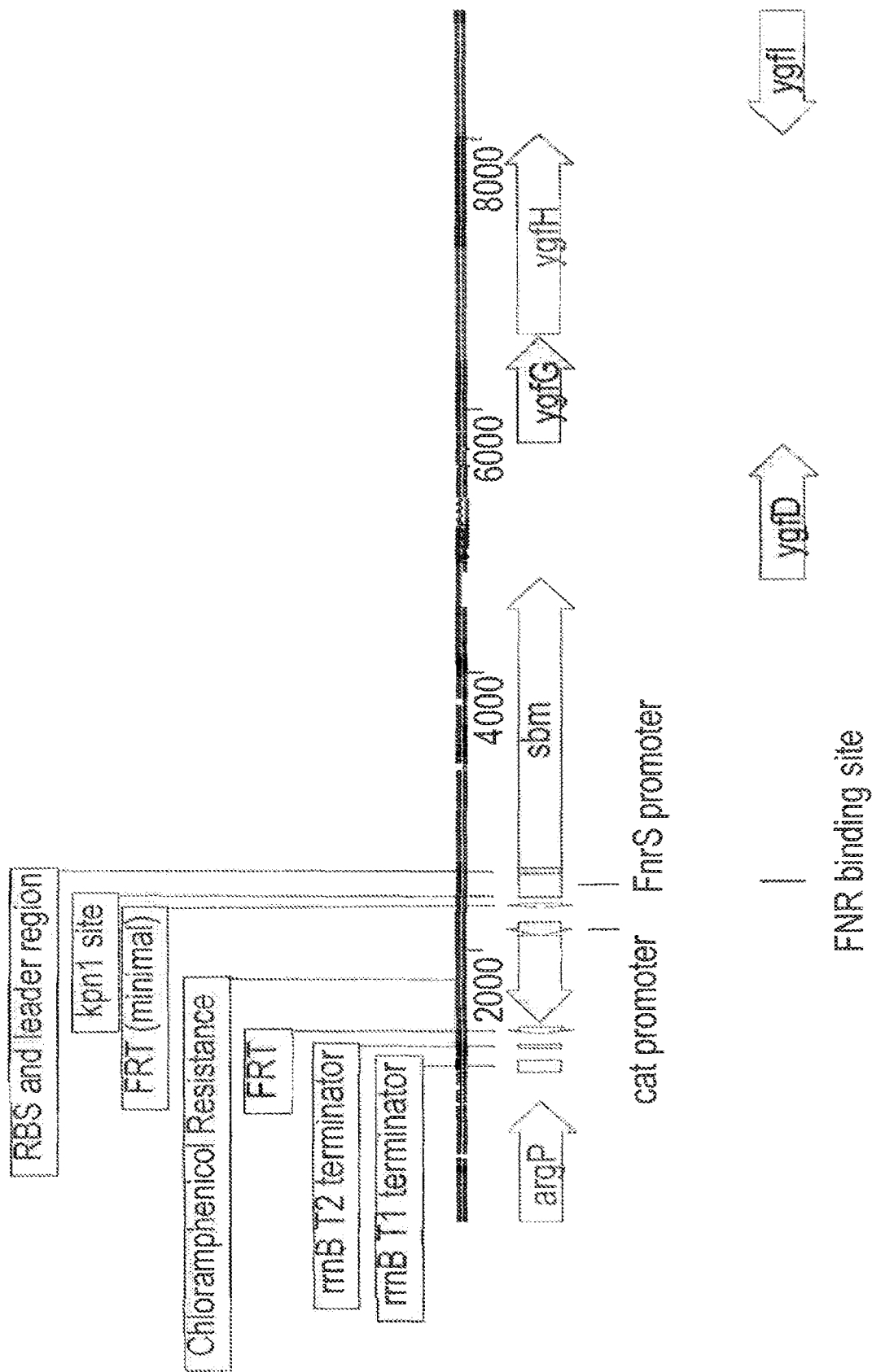
FIG. 20A a schematic of a construct comprising the sleeping beauty mutase operon from *E. coli* under the control of a heterologous FnrS promoter.
Figure 20B:
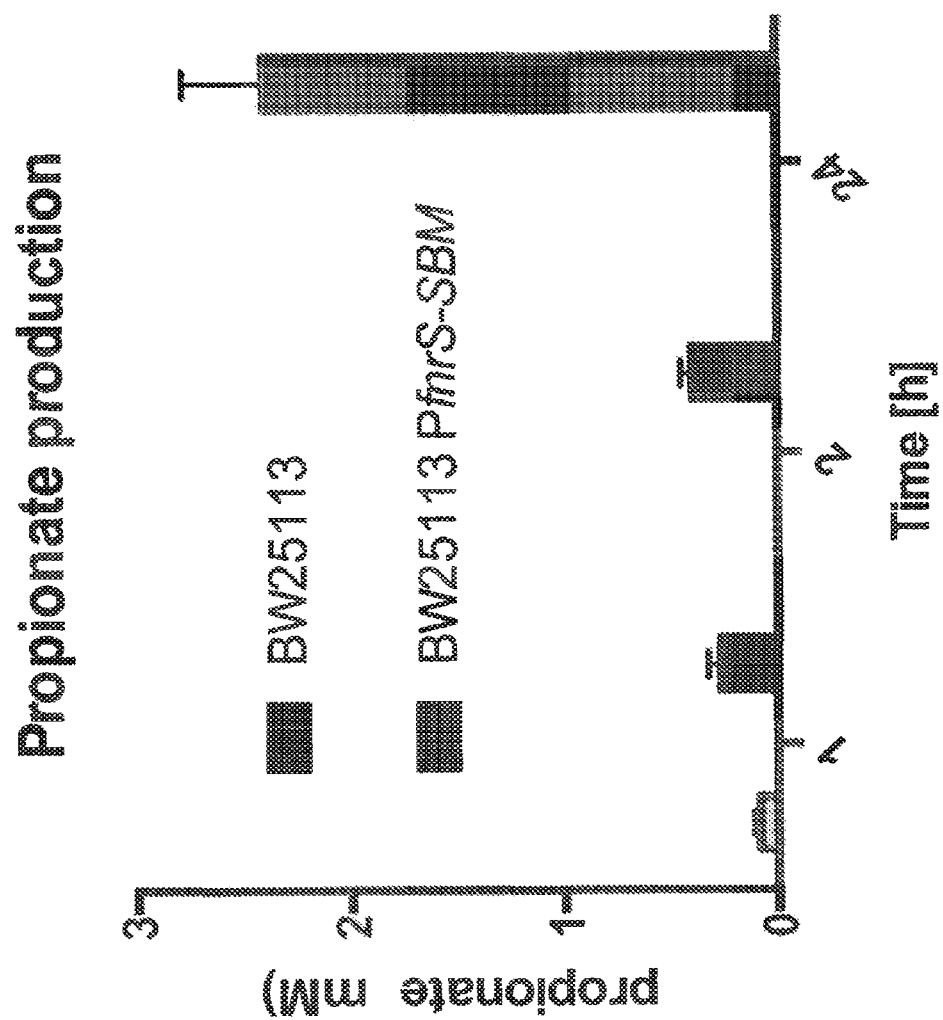
FIG. 20B depicts a bar graph of proprionate concentrations produced in vitro by the wild type *E. coli* BW25113 strain and a BW25113 strain which comprises the endogenous SBM operon under the control of the FnrS promoter, as depicted in the schematic in FIG. 20A.

Briefly, 3 ml LB (containing selective antibiotics (cam) where necessary was inoculated from frozen glycerol stocks with either wild type E. coli K12 or the genetically engineered bacteria comprising the chromosomal sleeping beauty mutase operon under the control of a FNR promoter. Bacteria were grown overnight at 37 C with shaking. Overnight cultures were diluted 1:100 into 10 ml LB in a 125 ml baffled flask. Cultures were grown aerobically at 37 C with shaking for about 1.5 h, and then transferred to the anaerobic chamber at 37 C for 4 h. Bacteria ($2 \times 10^8$ CFU) were added to 1 ml M9 media containing 50 mM MOPS with 0.5% glucose in microcentrifuge tubes. Cells were plated to determine cell counts. The assay tubes were placed in the anaerobic chamber at 37 C. At 1, 2, and 24 hours, 120 ul of cells were removed and pelleted at 14,000 rpm for 1 min, and 100 ul of the supernatant was transferred to a 96-well assay plate and sealed with aluminum foil, and stored at −80 C until analysis by LC-MS for propionate concentrations, as described in Results are depicted in FIG. 20B and show that the genetically engineered strain produces ~2.5 mM after 24 h, while very little or no propionate production was detected from the E. coli K12 wild type strain. Propionate was measured as described in Example 27.

Example 25. Evaluation of the Sleeping Beauty Mutase Pathway for the Production of Propionate in E. coli Nissle Next, the SBM pathway is evaluated for propionate production in E. coli Nissle. Nissle does not have the full 4-gene sleeping beauty mutase operon; it only has the first gene and a partial gene of the second, and genes 3 and 4 are missing. Therefore, recombineering is used to introduce this pathway into Nissle. The frt-cam-frt-PfnrS-sbm, ygfD, ygfG, ygfH construct is inserted at the location of the endogenous, truncated Nissle SBM. Next, the construct is transformed into E. coli Nissle and tested for propionate production essentially as described above.

Example 26. Evaluation of the Acrylate Pathway from Clostridium propionicum for Propionate Production The acrylate pathway from Clostridium propionicum is evaluated for adaptation to propionate production in E. coli. A construct (Ptet-pct-lcdABC-acrABC), codon optimized for E. coli, was synthesized by Genewiz and placed in a high copy plasmid (Logic051). Additionally, another construct is generated for side by side testing, in which the acrABC genes (which may be the rate limiting step of the pathway) are replaced with the acul gene from Rhodobacter sphaeroides (Ptet-acul-pct-lcdABC). Subsequently these constructs are transformed into BW25113 and are assessed for their ability to produce propionate, as compared to the type BW5113 strain as described above in Example 24. Propionate was measured as described in Example 27.

TABLE 46 of Exemplary Propionate Cassette Sequences

| Description and SEQ ID NO | Sequence |
|---|---|
| Ptet-pct-lcdABC-acrABC; Ptet: lower case; tertRitetA promoter within Ptet: lower case bold, with tet operator: lower case bold underlined; ribosome binding site and leader: lowe case italic; ribosome binding sites: lower case underlined; coding regions: upper case; (SEQ ID NO: 219) | ttaagacccactttcacatttaagttgttttttctaatccgcatatgatcaattcaagg<br>ccgaataagaaggctggctctgcaccttggtgatcaaataattcgatagcttgtc<br>gtaataatggcggcatactatcagtagtaggtgtttcccttcttctttagcgacttg<br>atgctcttgatcttccaatacgcaacctaaagtaaaatgccccacagcgctgagt<br>gcatataatgcattctctagtgaaaaaccttgttggcataaaaaggctaattgattt<br>tcgagagtttcatactgatttctgtaggccgtgtacctaaatgtacttttgctccatc<br>gcgatgacttagtaaagcacatctaaaactttagcgttattacgtaaaaaatcttg<br>ccagattcccccttctaaagggcaaaagtgagtatggtgcctatctaacatctca<br>atggctaaggcgtcgagcaaagcccgcttattttttacatgccaatacaatgtag<br>gctgctctacacctagcttctgggcgagtttacgggttgttaaaccttcgattccg<br>acctcattaagcagctctaatgcgctgttaatcactttactttttatctaatctagaca<br>tcattaattcctaattttttgttgacactctatcattgatagagttattttaccactc<br>cctatcagtgatagagaaaagtgaa*ctctagaaataattttgataactttaag*<br>*aaggagatatacat*ATGCGCAAAGTGCCGATTATCACG<br>GCTGACGAGGCCGCAAAACTGATCAAGGACGG<br>CGACACCGTGACAACTAGCGGCTTTGTGGGTAA |

TABLE 46-continued of Exemplary Propionate Cassette Sequences

| Description and SEQ ID NO | Sequence |
|---|---|
| | CGCGATCCCTGAGGCCCTTGACCGTGCAGTCGA<br>AAAGCGTTTCCTGGAAACGGGCGAACCGAAGA<br>ACATTACTTATGTATATTGCGGCAGTCAGGGCA<br>ATCGCGACGGTCGTGGCGCAGAACATTTCGCGC<br>ATGAAGGCCTGCTGAAACGTTATATCGCTGGCC<br>ATTGGGCGACCGTCCCGGCGTTAGGGAAAATGG<br>CCATGGAGAATAAAATGGAGGCCTACAATGTCT<br>CTCAGGGCGCCTTGTGTCATCTCTTTCGCGATAT<br>TGCGAGCCATAAACCGGGTGTGTTCACGAAAGT<br>AGGAATCGGCACCTTCATTGATCCACGTAACGG<br>TGGTGGGAAGGTCAACGATATTACCAAGGAAG<br>ATATCGTAGAACTGGTGGAAATTAAAGGGCAG<br>GAATACCTGTTTTATCCGGCGTTCCCGATCCATG<br>TCGCGCTGATTCGTGGCACCTATGCGGACGAGA<br>GTGGTAACATCACCTTTGAAAAAGAGGTAGCGC<br>CTTTGGAAGGGACTTCTGTCTGTCAAGCGGTGA<br>AGAACTCGGGTGGCATTGTCGTGGTTCAGGTTG<br>AGCGTGTCGTCAAAGCAGGCACGCTGGATCCGC<br>GCCATGTGAAAGTTCCGGGTATCTATGTAGATT<br>ACGTAGTCGTCGCGGATCCGGAGGACCATCAAC<br>AGTCCCTTGACTGCGAATATGATCCTGCCCTTA<br>GTGGAGAGCACCGTCGTCCGGAGGTGGTGGGT<br>GAACCACTGCCTTTATCCGCGAAGAAAGTCATC<br>GGCCGCCGTGGCGCGATTGAGCTCGAGAAAGA<br>CGTTGCAGTGAACCTTGGGGTAGGTGCACCTGA<br>GTATGTGGCCTCCGTGGCCGATGAAGAAGGCAT<br>TGTGGATTTTATGACTCTCACAGCGGAGTCCGG<br>CGCTATCGGTGGCGTTCCAGCCGGCGGTGTTCG<br>CTTTGGGGCGAGCTACAATGCTGACGCCTTGAT<br>CGACCAGGGCTACCAATTTGATTATTACGACGG<br>TGGGGGTCTGGATCTTTGTTACCTGGGTTTAGCT<br>GAATGCGACGAAAAGGGTAATATCAATGTTAG<br>CCGCTTCGGTCCTCGTATCGCTGGGTGCGGCGG<br>ATTCATTAACATTACCCAAAACACGCCGAAAGT<br>CTTCTTTTGTGGGACCTTTACAGCCGGGGGGCT<br>GAAAGTGAAAATTGAAGATGGTAAGGTGATTA<br>TCGTTCAGGAAGGGAAACAGAAGAAATTCCTTA<br>AGGCAGTGGAGCAAATCACCTTTAATGGAGAC<br>GTGGCCTTAGCGAACAAGCAACAAGTTACCTAC<br>ATCACGGAGCGTTGCGTCTTCCTCCTCAAAGAA<br>GACGGTTTACACCTTTCGGAAATCGCGCCAGGC<br>ATCGATCTGCAGACCCAGATTTTGGATGTTATG<br>GACTTTGCCCCGATCATTGATCGTGACGCAAAC<br>GGGCAGATTAAACTGATGGACGCGGCGTTATTC<br>GCAGAAGGGCTGATGGGCTTGAAAGAAATGAA<br>GTCTTGAtaagaaggagatatacatATGAGCTTAACCCAA<br>GGCATGAAAGCTAAACAACTGTTAGCATACTTT<br>CAGGGTAAAGCCGATCAGGATGCACGTGAAGC<br>GAAAGCCCGCGGTGAGCTGGTCTGCTGGTCGGC<br>GTCAGTCGCGCCGCCGGAATTTTGCGTAACAAT<br>GGGCATTGCCATGATCTACCCGGAGACTCATGC<br>AGCGGGCATCGGTGCCCGCAAAGGTGCGATGG<br>ACATGCTGGAAGTTGCGGACCGCAAAGGCTAC<br>AACGTGGATTGTTGTTCCTACGGCCGTGTAAAT<br>ATGGGTTACATGGAATGTTTAAAAGAAGCCGCC<br>ATCACGGGCGTCAAGCCGGAAGTTTTGGTTAAT<br>TCCCCTGCTGCTGACGTTCCGCTTCCCGATTTGG<br>TGATTACGTGTAATAATATCTGTAACACGCTGC<br>TGAAATGGTACGAAAACTTAGCAGCAGAACTC<br>GATATTCCTTGCATCGTGATCGACGTACCGTTTA<br>ATCATACCATGCCGATTCCGGAATATGCCAAGG<br>CCTACATCGCGGACCAGTTCCGCAATGCAATTT<br>CTCAGCTGGAAGTTATTTGTGGCCGTCCGTTCG<br>ATTGGAAGAAATTTAAGGAGGTCAAAGATCAG<br>ACCCAGCGTAGCGTATACCACTGGAACCGCATT<br>GCCGAGATGGCGAAATACAAGCCTAGCCCGCT<br>GAACGGCTTCGATCTGTTCAATTACATGGCGTT<br>AATCGTGGCGTGCCGCAGCCTGGATTATGCAGA<br>AATTACCTTTAAAGCGTTCGCGGACGAATTAGA<br>AGAGAATTTGAAGGCGGGTATCTACGCCTTTAA<br>AGGTGCGGAAAAACGCGCTTTCAATGGGAAG<br>GTATCGCGGTGTGGCCACATTTAGGTCACACGT<br>TTAAATCTATGAAGAATCTGAATTCGATTATGA<br>CCGGTACGGCATACCCCGCCCTTTGGGACCTGC<br>ACTATGACGCTAACGACGAATCTATGCACTCTA |

TABLE 46-continued of Exemplary Propionate Cassette Sequences

| Description and SEQ ID NO | Sequence |
|---|---|
| | TGGCTGAAGCGTACACCCGTATTTATATTAATA |
| | CTTGTCTGCAGAACAAAGTAGAGGTCCTGCTTG |
| | GGATCATGGAAAAAGGCCAGGTGGATGGTACC |
| | GTATATCATCTGAATCGCAGCTGCAAACTGATG |
| | AGTTTCCTGAACGTGGAAACGGCTGAAATTATT |
| | AAAGAGAAGAACGGTCTTCCTTACGTCTCCATT |
| | GATGGCGATCAGACCGATCCTCGCGTTTTTCTC |
| | CGGCCCAGTTTGATACCCGTGTTCAGGCCCTGG |
| | TTGAGATGATGGAGGCCAATATGGCGGCAGCG |
| | GAATAAtaagaaggagatatacatATGTCACGCGTGGAG |
| | GCAATCCTGTCGCAGCTGAAAGATGTCGCCGCG |
| | AATCCGAAAAAAGCCATGGATGACTATAAAGC |
| | TGAAACAGGTAAGGGCGCGGTTGGTATCATGCC |
| | GATCTACAGCCCCGAAGAAATGGTACACGCCGC |
| | TGGCTATTTGCCGATGGGAATCTGGGGCGCCCA |
| | GGGCAAAACGATTAGTAAAGCGCGCACCTATCT |
| | GCCTGCTTTTGCCTGCAGCGTAATGCAGCAGGT |
| | TATGGAATTACAGTGCGAGGGCGCGTATGATGA |
| | CCTGTCCGCAGTTATTTTTAGCGTACCGTGCGAC |
| | ACTCTCAAATGTCTTAGCCAGAAATGGAAAGGT |
| | ACGTCCCCAGTGATTGTATTTACGCATCCGCAG |
| | AACCGCGGATTAGAAGCGGCGAACCAATTCTTG |
| | GTTACCGAGTATGAACTGGTAAAAGCACAACTG |
| | GAATCAGTTCTGGGTGTGAAAATTTCAAACGCC |
| | GCCCTGGAAAATTCGATTGCAATTTATAACGAG |
| | AATCGTGCCGTGATGCGTGAGTTCGTGAAAGTG |
| | GCAGCGGACTATCCTCAAGTCATTGACGCAGTG |
| | AGCCGCCACGCGGTTTTTAAAGCGCGCCAGTTT |
| | ATGCTTAAGGAAAAACATACCGCACTTGTGAAA |
| | GAACTGATCGCTGAGATTAAAGCAACGCCAGTC |
| | CAGCCGTGGGACGGAAAAAAGGTTGTAGTGAC |
| | GGGCATTCTGTTGGAACCGAATGAGTTATTAGA |
| | TATCTTTAATGAGTTTAAGATCGCGATTGTTGAT |
| | GATGATTTAGCGCAGGAAAGCCGTCAGATCCGT |
| | GTTGACGTTCTGGACGGAGAAGGCGGACCGCTC |
| | TACCGTATGGCTAAAGCGTGGCAGCAAATGTAT |
| | GGCTGCTCGCTGGCAACCGACACCAAGAAGGG |
| | TCGCGGCCGTATGTTAATTAACAAAACGATTCA |
| | GACCGGTGCGGACGCTATCGTAGTTGCAATGAT |
| | GAAGTTTTGCGACCCAGAAGAATGGGATTATCC |
| | GGTAATGTACCGTGAATTTGAAGAAAAAGGGG |
| | TCAAATCACTTATGATTGAGGTGGATCAGGAAG |
| | TATCGTCTTTCGAACAGATTAAAACCCGTCTGC |
| | AGTCATTCGTCGAAATGCTTTAAtaagaaggagatataca |
| | tATGTATACCTTGGGGATTGATGTCGGTTCTGCC |
| | TCTAGTAAAGCGGTGATTCTGAAAGATGGAAAA |
| | GATATTGTCGCTGCCGAGGTTGTCCAAGTCGGT |
| | ACCGGCTCCTCGGGTCCCCAACGCGCACTGGAC |
| | AAAGCCTTTGAAGTCTCTGGCTTAAAAAAGGAA |
| | GACATCAGCTACACAGTAGCTACGGGCTATGGG |
| | CGCTTCAATTTTAGCGACGCGGATAAACAGATT |
| | TCGGAAATTAGCTGTCATGCCAAAGGCATTTAT |
| | TTCTTAGTACCAACTGCGCGCACTATTATTGAC |
| | ATTGGCGGCCAAGATGCGAAAGCCATCCGCCTG |
| | GACGACAAGGGGGTATTAAGCAATTCTTCATG |
| | AATGATAAATGCGCGGCGGGCACGGGGCGTTTC |
| | CTGGAAGTCATGGCTCGCGTACTTGAAACCACC |
| | CTGGATGAAATGGCTGAACTGGATGAACAGGC |
| | GACTGACACCGCTCCCATTTCAAGCACCTGCAC |
| | GGTTTTCGCCGAAAGCGAAGTAATTAGCCAATT |
| | GAGCAATGGTGTCTCACGCAACAACATCATTAA |
| | AGGTGTCCATCTGAGCGTTGCGTCACGTGCGTG |
| | TGGTCTGGCGTATCGCGGCGGTTTGGAGAAAGA |
| | TGTTGTTATGACAGGTGGCGTGGCAAAAAATGC |
| | AGGGGTGGTGCGCGCGGTGGCGGGCGTTCTGA |
| | AGACCGATGTTATCGTTGCTCCGAATCCTCAGA |
| | CGACCGGTGCACTGGGGGCAGCGCTGTATGCTT |
| | ATGAGGCCGCCCAGAAGAAGTAAtaagaaggagatata |
| | catATGGCCTTCAATAGCGCAGATATTAATTCTTT |
| | CCGCGATATTTGGGTGTTTTGTGAACAGCGTGA |
| | GGGCAAACTGATTAACACCGATTTCGAATTAAT |
| | TAGCGAAGGTCGTAAACTGGCTGACGAACGCG |
| | GAAGCAAACTGGTTGGAATTTTGCTGGGGCACG |
| | AAGTTGAAGAAATCGCAAAAGAATTAGGCGGC |
| | TATGGTGCGGACAAGGTAATTGTGTGCGATCAT |

TABLE 46-continued of Exemplary Propionate Cassette Sequences

| Description and SEQ ID NO | Sequence |
|---|---|
| | CCGGAACTTAAATTTTACACTACGGATGCTTAT |
| | GCCAAAGTTTTATGTGACGTCGTGATGGAAGAG |
| | AAACCGGAGGTAATTTTGATCGGTGCCACCAAC |
| | ATTGGCCGTGATCTCGGACCGCGTTGTGCTGCA |
| | CGCTTGCACACGGGGCTGACGGCTGATTGCACG |
| | CACCTGGATATTGATATGAATAAATATGTGGAC |
| | TTTCTTAGCACCAGTAGCACCTTGGATATCTCGT |
| | CGATGACTTTCCCTATGGAAGATACAAACCTTA |
| | AAATGACGCGCCCTGCATTTGGCGGACATCTGA |
| | TGGCAACGATCATTTGTCCACGCTTCCGTCCCTG |
| | TATGAGCACAGTGCGCCCCGGAGTGATGAAGA |
| | AAGCGGAGTTCTCGCAGGAGATGGCGCAAGCA |
| | TGTCAAGTAGTGACCCGTCACGTAAATTTGTCG |
| | GATGAAGACCTTAAAACTAAAGTAATTAATATC |
| | GTGAAGGAAACGAAAAAGATTGTGGATCTGAT |
| | CGGCGCAGAAATTATTGTGTCAGTTGGTCGTGG |
| | TATCTCGAAAGATGTCCAAGGTGGAATTGCACT |
| | GGCTGAAAAACTTGCGGACGCATTTGGTAACGG |
| | TGTCGTGGGCGGCTCGCGCGCAGTGATTGATTC |
| | CGGCTGGTTACCTGCGGATCATCAGGTTGGACA |
| | AACCGGTAAGACCGTGCACCCGAAAGTCTACGT |
| | GGCGCTGGGTATTAGTGGGGCTATCCAGCATAA |
| | GGCTGGGATGCAAGACTCTGAACTGATCATTGC |
| | CGTCAACAAAGACGAAACGGCGCCTATCTTCGA |
| | CTGCGCCGATTATGGCATCACCGGTGATTTATTT |
| | AAAATCGTACCGATGATGATCGACGCGATCAAA |
| | GAGGGTAAAAACGCATGAtaagaaggagatatacatATG |
| | CGCATCTATGTGTGTGTGAAACAAGTCCCAGAT |
| | ACGAGCGGCAAGGTGGCCGTTAACCCTGATGG |
| | GACCCTTAACCGTGCCTCAATGGCAGCGATTAT |
| | TAACCCGGACGATATGTCCGCGATCGAACAGGC |
| | ATTAAAACTGAAAGATGAAACCGGATGCCAGG |
| | TTACGGCGCTTACGATGGGTCCTCCTCCTGCCG |
| | AGGGCATGTTGCGCGAAATTATTGCAATGGGGG |
| | CCGACGATGGTGTGCTGATTTCGGCCCGTGAAT |
| | TTGGGGGGTCCGATACCTTCGCAACCAGTCAAA |
| | TTATTAGCGCGGCAATCCATAAATTAGGCTTAA |
| | GCAATGAAGACATGATCTTTTGCGGTCGTCAGG |
| | CCATTGACGGTGATACGGCCCAAGTCGGCCCTC |
| | AAATTGCCGAAAAACTGAGCATCCCACAGGTA |
| | ACCTATGGCGCAGGAATCAAAAAATCTGGTGAT |
| | TTAGTGCTGGTGAAGCGTATGTTGGAGGATGGT |
| | TATATGATGATCGAAGTCGAAACTCCATGTCTG |
| | ATTACCTGCATTCAGGATAAAGCGGTAAAACCA |
| | CGTTACATGACTCTCAACGGTATTATGGAATGC |
| | TACTCCAAGCCGCTCCTCGTTCTCGATTACGAA |
| | GCACTGAAAGATGAACCGCTGATCGAACTTGAT |
| | ACCATTGGGCTTAAAGGCTCCCCGACGAATATC |
| | TTTAAATCGTTTACGCCGCCTCAGAAAGGCGTT |
| | GGTGTCATGCTCCAAGGCACCGATAAGGAAAA |
| | AGTCGAGGATCTGGTGGATAAGCTGATGCAGA |
| | AACATGTCATCTAAtaagaaggagatatacatATGTTCTT |
| | ACTGAAGATTAAAAAAGAACGTATGAAACGCA |
| | TGGACTTTAGTTTAACGCGTGAACAGGAGATGT |
| | TAAAAAAACTGGCGCGTCAGTTTGCTGAGATCG |
| | AGCTGGAACCGGTGGCCGAAGAGATTGATCGT |
| | GAGCACGTTTTTCCTGCAGAAAACTTTAAGAAG |
| | ATGGCGGAAATTGGCTTAACCGGCATTGGTATC |
| | CCGAAAGAATTTGGTGGCTCCGGTGGAGGCACC |
| | CTGGGAGAAGGTCATTGCCGTGTCAGAATTCGGC |
| | AAAAAGTGTATGGCCTCAGCTTCCATTTTAAGC |
| | ATTCATCTTATCGCGCCGCAGGCAATCTACAAA |
| | TATGGGACCAAAGAACAGAAAGAGACGTACCT |
| | GCCGCGTCTTACCAAAGGTGGTGAACTGGGCGC |
| | CTTTGCGCTGACAGAACCAAACGCCGGAAGCG |
| | ATGCCGGCGCGGTAAAAACGACCGCGATTCTGG |
| | ACAGCCAGACAAACGAGTACGTGCTGAATGGC |
| | ACCAAATGCTTTATCAGCGGGGCGGGCGCGCG |
| | GGTGTTCTTGTAATTTTTGCGCTTACTGAACCGA |
| | AAAAAGGTCTGAAAGGGATGAGCGCGATTATC |
| | GTGGAGAAAGGGACCCCGGGCTTCAGCATCGG |
| | CAAGGTGGAGAGCAAGATGGGGATCGCAGGTT |
| | CGGAAACCGCGGAACTTATCTTCGAAGATTGTC |
| | GCGTTCCGGCTGCCAACCTTTTAGGTAAAGAAG |
| | GCAAAGGCTTTAAAATTGCTATGGAAGCCCTGG |

TABLE 46-continued of Exemplary Propionate Cassette Sequences

| Description and SEQ ID NO | Sequence |
|---|---|
| | ATGGCGCCCGTATTGGCGTGGGCGCTCAAGCAA<br>TCGGAATTGCCGAGGGGGCGATCGACCTGAGTG<br>TGAAGTACGTTCACGAGCGCATTCAATTTGGTA<br>AACCGATCGCGAATCTGCAGGGAATTCAATGGT<br>ATATCGCGGATATGGCGACCAAAACCGCCGCG<br>GCACGCGCACTTGTTGAGTTTGCAGCGTATCTT<br>GAAGACGCGGGTAAACCGTTCACAAAGGAATC<br>TGCTATGTGCAAGCTGAACGCCTCCGAAAACGC<br>GCGTTTTGTGACAAATTTAGCTCTGCAGATTCA<br>CGGGGGTTACGGTTATATGAAAGATTATCCGTT<br>AGAGCGTATGTATCGCGATGCTAAGATTACGGA<br>AATTTACGAGGGGACATCAGAAATCCATAAGGT<br>GGTGATTGCGCGTGAAGTAATGAAACGCTAA |
| pct-lcdABC-acrABC (ribosome binding sites: lower case underlined; coding regions: upper case) (SEQ ID NO: 220) | ATGCGCAAAGTGCCGATTATCACGGCTGACGAG<br>GCCGCAAAACTGATCAAGGACGGCGACACCGT<br>GACAACTAGCGGCTTTGTGGGTAACGCGATCCC<br>TGAGGCCCTTGACCGTGCAGTCGAAAAGCGTTT<br>CCTGGAAACGGGCGAACCGAAGAACATTACTT<br>ATGTATATTGCGGCAGTCAGGGCAATCGCGACG<br>GTCGTGGCGCAGAACATTTCGCGCATGAAGGCC<br>TGCTGAAACGTTATATCGCTGGCCATTGGGCGA<br>CCGTCCCGGCGTTAGGGAAAATGGCCATGGAG<br>AATAAAATGGAGGCCTACAATGTCTCTCAGGGC<br>GCCTTGTGTCATCTCTTTCGCGATATTGCGAGCC<br>ATAAACCGGGTGTGTTCACGAAAGTAGGAATCG<br>GCACCTTCATTGATCCACGTAACGGTGGTGGGA<br>AGGTCAACGATATTACCAAGGAAGATATCGTAG<br>AACTGGTGGAAATTAAAGGGCAGGAATACCTG<br>TTTTATCCGGCGTTCCCGATCCATGTCGCGCTGA<br>TTCGTGGCACCTATGCGGACGAGAGTGGTAACA<br>TCACCTTTGAAAAAGAGGTAGCGCCTTTGGAAG<br>GGACTTCTGTCTGTCAAGCGGTGAAGAACTCGG<br>GTGGCATTGTCGTGGTTCAGGTTGAGCGTGTCG<br>TCAAAGCAGGCACGCTGGATCCGCGCCATGTGA<br>AAGTTCCGGGTATCTATGTAGATTACGTAGTCG<br>TCGCGGATCCGGAGGACCATCAACAGTCCCTTG<br>ACTGCGAATATGATCCTGCCCTTAGTGGAGAGC<br>ACCGTCGTCCGGAGGTGGTGGGTGAACCACTGC<br>CTTTATCCGCGAAGAAAGTCATCGGCCGCCGTG<br>GCGCGATTGAGCTCGAGAAAGACGTTGCAGTG<br>AACCTTGGGGTAGGTGCACCTGAGTATGTGGCC<br>TCCGTGGCCGATGAAGAAGGCATTGTGGATTTT<br>ATGACTCTCACAGCGGAGTCCGGCGCTATCGGT<br>GGCGTTCCAGCCGGCGGTGTTCGCTTTGGGGCG<br>AGCTACAATGCTGACGCCTTGATCGACCAGGGC<br>TACCAATTTGATTATTACGACGGTGGGGTCTG<br>GATCTTTGTTACCTGGGTTTAGCTGAATGCGAC<br>GAAAAGGGTAATATCAATGTTAGCCGCTTCGGT<br>CCTCGTATCGCTGGGTGCGGCGGATTCATTAAC<br>ATTACCCAAAACACGCCGAAAGTCTTCTTTTGT<br>GGGACCTTTACAGCCGGGGGCTGAAAGTGAA<br>AATTGAAGATGGTAAGGTGATTATCGTTCAGGA<br>AGGGAAACAGAAGAAATTCCTTAAGGCAGTGG<br>AGCAAATCACCTTTAATGGAGACGTGGCCTTAG<br>CGAACAAGCAACAAGTTACCTACATCACGGAG<br>CGTTGCGTCTTCCTCCTCAAAGAAGACGGTTTA<br>CACCTTTCGGAAATCGCGCCAGGCATCGATCTG<br>CAGACCCAGATTTTGGATGTTATGGACTTTGCC<br>CCGATCATTGATCGTGACGCAAACGGGCAGATT<br>AAACTGATGGACGCGGCGTTATTCGCAGAAGG<br>GCTGATGGGCTTGAAAGAAATGAAGTCTTGAtaa<br><u>gaaggagatatacat</u>ATGAGCTTAACCCAAGGCATGAA<br>AGCTAAACAACTGTTAGCATACTTTCAGGGTAA<br>AGCCGATCAGGATGCACGTGAAGCGAAAGCCC<br>GCGGTGAGCTGGTCTGCTGGTCGGCGTCAGTCG<br>CGCCGCCGGAATTTTGCGTAACAATGGGCATTG<br>CCATGATCTACCCGGAGACTCATGCAGCGGGCA<br>TCGGTGCCCGCAAAGGTGCGATGGACATGCTGG<br>AAGTTGCGGACCGCAAAGGCTACAACGTGGATT<br>GTTGTTCCTACGGCCGTGTAAATATGGGTTACA<br>TGGAATGTTTAAAAGAAGCCGCCATCACGGGCG<br>TCAAGCCGGAAGTTTTGGTTAATTCCCCTGCTG<br>CTGACGTTCCGCTTCCCGATTTGGTGATTACGTG<br>TAATAATATCTGTAACACGCTGCTGAAATGGTA |

TABLE 46-continued of Exemplary Propionate Cassette Sequences

| Description and SEQ ID NO | Sequence |
|---|---|
| | CGAAAACTTAGCAGCAGAACTCGATATTCCTTG<br>CATCGTGATCGACGTACCGTTTAATCATACCAT<br>GCCGATTCCGGAATATGCCAAGGCCTACATCGC<br>GGACCAGTTCCGCAATGCAATTTCTCAGCTGGA<br>AGTTATTTGTGGCCGTCCGTTCGATTGGAAGAA<br>ATTTAAGGAGGTCAAAGATCAGACCCAGCGTA<br>GCGTATACCACTGGAACCGCATTGCCGAGATGG<br>CGAAATACAAGCCTAGCCCGCTGAACGGCTTCG<br>ATCTGTTCAATTACATGGCGTTAATCGTGGCGT<br>GCCGCAGCCTGGATTATGCAGAAATTACCTTTA<br>AAGCGTTCGCGGACGAATTAGAAGAGAATTTG<br>AAGGCGGGTATCTACGCCTTTAAAGGTGCGGAA<br>AAAACGCGCTTTCAATGGGAAGGTATCGCGGTG<br>TGGCCACATTTAGGTCACACGTTTAAATCTATG<br>AAGAATCTGAATTCGATTATGACCGGTACGGCA<br>TACCCCGCCCTTTGGGACCTGCACTATGACGCT<br>AACGACGAATCTATGCACTCTATGGCTGAAGCG<br>TACACCCGTATTTATATTAATACTTGTCTGCAGA<br>ACAAAGTAGAGGTCCTGCTTGGGATCATGGAAA<br>AAGGCCAGGTGGATGGTACCGTATATCATCTGA<br>ATCGCAGCTGCAAACTGATGAGTTTCCTGAACG<br>TGGAAACGGCTGAAATTATTAAAGAGAAGAAC<br>GGTCTTCCTTACGTCTCCATTGATGGCGATCAG<br>ACCGATCCTCGCGTTTTTCTCCGGCCCAGTTTG<br>ATACCCGTGTTCAGGCCCTGGTTGAGATGATGG<br>AGGCCAATATGGCGGCAGCGGAATAAt<u>aagaaggag</u><br><u>atatacat</u>ATGTCACGCGTGGAGGCAATCCTGTCGC<br>AGCTGAAAGATGTCGCCGCGAATCCGAAAAAA<br>GCCATGGATGACTATAAAGCTGAAACAGGTAA<br>GGGCGCGGTTGGTATCATGCCGATCTACAGCCC<br>CGAAGAAATGGTACACGCCGCTGGCTATTTGCC<br>GATGGGAATCTGGGGCGCCCAGGGCAAAACGA<br>TTAGTAAAGCGCGCACCTATCTGCCTGCTTTTGC<br>CTGCAGCGTAATGCAGCAGGTTATGGAATTACA<br>GTGCGAGGGCGCGTATGATGACCTGTCCGCAGT<br>TATTTTTAGCGTACCGTGCGACACTCTCAAATGT<br>CTTAGCCAGAAATGGAAAGGTACGTCCCCAGTG<br>ATTGTATTTACGCATCCGCAGAACCGCGGATTA<br>GAAGCGGCGAACCAATTCTTGGTTACCGAGTAT<br>GAACTGGTAAAAGCACAACTGGAATCAGTTCTG<br>GGTGTGAAAATTTCAAACGCCGCCCTGGAAAAT<br>TCGATTGCAATTTATAACGAGAATCGTGCCGTG<br>ATGCGTGAGTTCGTGAAAGTGGCAGCGGACTAT<br>CCTCAAGTCATTGACGCAGTGAGCCGCCACGCG<br>GTTTTTAAAGCGCGCCAGTTTATGCTTAAGGAA<br>AAACATACCGCACTTGTGAAAGAACTGATCGCT<br>GAGATTAAAGCAACGCCAGTCCAGCCGTGGGA<br>CGGAAAAAAGGTTGTAGTGACGGGCATTCTGTT<br>GGAACCGAATGAGTTATTAGATATCTTTAATGA<br>GTTTAAGATCGCGATTGTTGATGATGATTTAGC<br>GCAGGAAAGCCGTCAGATCCGTGTTGACGTTCT<br>GGACGGAGAAGGCGGACCGCTCTACCGTATGG<br>CTAAAGCGTGGCAGCAAATGTATGGCTGCTCGC<br>TGGCAACCGACACCAAGAAGGGTCGCGGCCGT<br>ATGTTAATTAACAAAACGATTCAGACCGGTGCG<br>GACGCTATCGTAGTTGCAATGATGAAGTTTTGC<br>GACCCAGAAGAATGGGATTATCCGGTAATGTAC<br>CGTGAATTTGAAGAAAAAGGGGTCAAATCACTT<br>ATGATTGAGGTGGATCAGGAAGTATCGTCTTTC<br>GAACAGATTAAAACCCGTCTGCAGTCATTCGTC<br>GAAATGCTTTAAt<u>aagaaggagatatacat</u>ATGTATACCT<br>TGGGGATTGATGTCGGTTCTGCCTCTAGTAAAG<br>CGGTGATTCTGAAAGATGGAAAAGATATTGTCG<br>CTGCCGAGGTTGTCCAAGTCGGTACCGGCTCCT<br>CGGGTCCCCAACGCGCACTGGACAAAGCCTTTG<br>AAGTCTCTGGCTTAAAAAAGGAAGACATCAGCT<br>ACACAGTAGCTACGGGCTATGGGCGCTTCAATT<br>TTAGCGACGCGGATAAACAGATTTCGGAAATTA<br>GCTGTCATGCCAAAGGCATTTATTTCTTAGTACC<br>AACTGCGCGCACTATTATTGACATTGGCGGCCA<br>AGATGCGAAAGCCATCCGCCTGGACGACAAGG<br>GGGGTATTAAGCAATTCTTCATGAATGATAAAT<br>GCGCGGCGGGCACGGGGCGTTTCCTGGAAGTCA<br>TGGCTCGCGTACTTGAAACCACCCTGGATGAAA<br>TGGCTGAACTGGATGAACAGGCGACTGACACC |

TABLE 46-continued of Exemplary Propionate Cassette Sequences

| Description and SEQ ID NO | Sequence |
|---|---|
| | GCTCCCATTTCAAGCACCTGCACGGTTTTCGCC |
| | GAAAGCGAAGTAATTAGCCAATTGAGCAATGG |
| | TGTCTCACGCAACAACATCATTAAAGGTGTCCA |
| | TCTGAGCGTTGCGTCACGTGCGTGTGGTCTGGC |
| | GTATCGCGGCGGTTTGGAGAAAGATGTTGTTAT |
| | GACAGGTGGCGTGGCAAAAAATGCAGGGGTGG |
| | TGCGCGCGGTGGCGGGCGTTCTGAAGACCGATG |
| | TTATCGTTGCTCCGAATCCTCAGACGACCGGTG |
| | CACTGGGGGCAGCGCTGTATGCTTATGAGGCCG |
| | CCCAGAAGAAGTAAtaagaaggagatatacatATGGCCTT |
| | CAATAGCGCAGATATTAATTCTTTCCGCGATAT |
| | TTGGGTGTTTTGTGAACAGCGTGAGGGCAAACT |
| | GATTAACACCGATTTCGAATTAATTAGCGAAGG |
| | TCGTAAACTGGCTGACGAACGCGGAAGCAAAC |
| | TGGTTGGAATTTTGCTGGGGCACGAAGTTGAAG |
| | AAATCGCAAAAGAATTAGGCGGCTATGGTGCG |
| | GACAAGGTAATTGTGTGCGATCATCCGGAACTT |
| | AAATTTTACACTACGGATGCTTATGCCAAAGTT |
| | TTATGTGACGTCGTGATGGAAGAGAAACCGGA |
| | GGTAATTTTGATCGGTGCCACCAACATTGGCCG |
| | TGATCTCGGACCGCGTTGTGCTGCACGCTTGCA |
| | CACGGGGCTGACGGCTGATTGCACGCACCTGGA |
| | TATTGATATGAATAAATATGTGGACTTTCTTAG |
| | CACCAGTAGCACCTTGGATATCTCGTCGATGAC |
| | TTTCCCTATGGAAGATACAAACCTTAAAATGAC |
| | GCGCCCTGCATTTGGCGGACATCTGATGGCAAC |
| | GATCATTTGTCCACGCTTCCGTCCCTGTATGAGC |
| | ACAGTGCGCCCCGGAGTGATGAAGAAAGCGGA |
| | GTTCTCGCAGGAGATGGCGCAAGCATGTCAAGT |
| | AGTGACCCGTCACGTAAATTTGTCGGATGAAGA |
| | CCTTAAAACTAAAGTAATTAATATCGTGAAGGA |
| | AACGAAAAGATTGTGGATCTGATCGGCGCAG |
| | AAATTATTGTGTCAGTTGGTCGTGGTATCTCGA |
| | AAGATGTCCAAGGTGGAATTGCACTGGCTGAAA |
| | AACTTGCGGACGCATTTGGTAACGGTGTCGTGG |
| | GCGGCTCGCGCGCAGTGATTGATTCCGGCTGGT |
| | TACCTGCGGATCATCAGGTTGGACAAACCGGTA |
| | AGACCGTGCACCCGAAAGTCTACGTGGCGCTGG |
| | GTATTAGTGGGGCTATCCAGCATAAGGCTGGGA |
| | TGCAAGACTCTGAACTGATCATTGCCGTCAACA |
| | AAGACGAAACGGCGCCTATCTTCGACTGCGCCG |
| | ATTATGGCATCACCGGTGATTTATTTAAAATCG |
| | TACCGATGATGATCGACGCGATCAAAGAGGGT |
| | AAAAACGCATGAtaagaaggagatatacatATGCGCATCT |
| | ATGTGTGTGTGAAACAAGTCCCAGATACGAGCG |
| | GCAAGGTGGCCGTTAACCCTGATGGGACCCTTA |
| | ACCGTGCCTCAATGGCAGCGATTATTAACCCGG |
| | ACGATATGTCCGCGATCGAACAGGCATTAAAAC |
| | TGAAAGATGAAACCGGATGCCAGGTTACGGCG |
| | CTTACGATGGGTCCTCCTCCTGCCGAGGGCATG |
| | TTGCGCGAAATTATTGCAATGGGGGCCGACGAT |
| | GGTGTGCTGATTTCGGCCCGTGAATTTGGGGGG |
| | TCCGATACCTTCGCAACCAGTCAAATTATTAGC |
| | GCGGCAATCCATAAATTAGGCTTAAGCAATGAA |
| | GACATGATCTTTTGCGGTCGTCAGGCCATTGAC |
| | GGTGATACGGCCCAAGTCGGCCCTCAAATTGCC |
| | GAAAAACTGAGCATCCCACAGGTAACCTATGGC |
| | GCAGGAATCAAAAAATCTGGTGATTTAGTGCTG |
| | GTGAAGCGTATGTTGGAGGATGGTTATATGATG |
| | ATCGAAGTCGAAACTCCATGTCTGATTACCTGC |
| | ATTCAGGATAAAGCGGTAAAACCACGTTACATG |
| | ACTCTCAACGGTATTATGGAATGCTACTCCAAG |
| | CCGCTCCTCGTTCTCGATTACGAAGCACTGAAA |
| | GATGAACCGCTGATCGAACTTGATACCATTGGG |
| | CTTAAAGGCTCCCCGACGAATATCTTTAAATCG |
| | TTTACGCCGCCTCAGAAAGGCGTTGGTGTCATG |
| | CTCCAAGGCACCGATAAGGAAAAAGTCGAGGA |
| | TCTGGTGGATAAGCTGATGCAGAAACATGTCAT |
| | CTAAtaagaaggagatatacatATGTTCTTACTGAAGATT |
| | AAAAAAGAACGTATGAAACGCATGGACTTTAG |
| | TTTAACGCGTGAACAGGAGATGTTAAAAAAACT |
| | GGCGCGTCAGTTTGCTGAGATCGAGCTGGAACC |
| | GGTGGCCGAAGAGATTGATCGTGAGCACGTTTT |
| | TCCTGCAGAAAACTTTAAGAAGATGGCGGAAAT |
| | TGGCTTAACCGGCATTGGTATCCCGAAAGAATT |

TABLE 46-continued of Exemplary Propionate Cassette Sequences

| Description and SEQ ID NO | Sequence |
|---|---|
| | TGGTGGCTCCGGTGGAGGCACCCTGGAGAAGGT<br>CATTGCCGTGTCAGAATTCGGCAAAAAGTGTAT<br>GGCCTCAGCTTCCATTTTAAGCATTCATCTTATC<br>GCGCCGCAGGCAATCTACAAATATGGGACCAA<br>AGAACAGAAAGAGACGTACCTGCCGCGTCTTAC<br>CAAAGGTGGTGAACTGGGCGCCTTTGCGCTGAC<br>AGAACCAAACGCCGGAAGCGATGCCGGCGCGG<br>TAAAAACGACCGCGATTCTGGACAGCCAGACA<br>AACGAGTACGTGCTGAATGGCACCAAATGCTTT<br>ATCAGCGGGGCGGGCGCGCGGGTGTTCTTGTA<br>ATTTTTGCGCTTACTGAACCGAAAAAAGGTCTG<br>AAAGGGATGAGCGCGATTATCGTGGAGAAAGG<br>GACCCCGGGCTTCAGCATCGGCAAGGTGGAGA<br>GCAAGATGGGGATCGCAGGTTCGGAAACCGCG<br>GAACTTATCTTCGAAGATTGTCGCGTTCCGGCT<br>GCCAACCTTTTAGGTAAAGAAGGCAAAGGCTTT<br>AAAATTGCTATGGAAGCCCTGGATGGCGCCCGT<br>ATTGGCGTGGGCGCTCAAGCAATCGGAATTGCC<br>GAGGGGGCGATCGACCTGAGTGTGAAGTACGTT<br>CACGAGCGCATTCAATTTGGTAAACCGATCGCG<br>AATCTGCAGGGAATTCAATGGTATATCGCGGAT<br>ATGGCGACCAAAACCGCCGCGGCACGCGCACTT<br>GTTGAGTTTGCAGCGTATCTTGAAGACGCGGGT<br>AAACCGTTCACAAAGGAATCTGCTATGTGCAAG<br>CTGAACGCCTCCGAAAACGCGCGTTTTGTGACA<br>AATTTAGCTCTGCAGATTCACGGGGGTTACGGT<br>TATATGAAAGATTATCCGTTAGAGCGTATGTAT<br>CGCGATGCTAAGATTACGGAAATTTACGAGGGG<br>ACATCAGAAATCCATAAGGTGGTGATTGCGCGT<br>GAAGTAATGAAACGCTAA |
| Ptet-acuI-pct-lcdABC (Ptet: lower case; tetA/R promoter within Ptet: lower case bold, with tet operator underlined; RBS and leader region lower case italic; ribosome binding site: lower case underlined italic; coding region: upper case, rrnB T1 and T2 terminors: lower case bold underline italics) (SEQ ID NO: 221) | caactgttgggaagggcgatcggtgcgggcctcttcgctattacgccagctgg<br>cgaaaggggatgtgctgcaaggcgattaagtttgggtaacgccagggttttcc<br>cagtcacgacgttgtaaaacgacggccagtgaattgacgcgtattgggatgta<br>aaacgacggccagtgaattcgttaagacccactttcacatttaagttgatttctaa<br>tccgcatatgatcaattcaaggccgaataagaaggctggctctgcaccttggtg<br>atcaaataattcgatagcttgtcgtaataatggcggcatactatcagtagtaggtg<br>tttccctttcttctttagcgacttgatgctcttgatcttccaatacgcaacctaaagta<br>aaatgccccacagcgctgagtgcatataatgcattctctagtgaaaaaccttgtt<br>ggcataaaaaggctaattgattttcgagagtttcatactgatttctgtaggccgtg<br>tacctaaatgtactttttgctccatcgcgatgacttagtaaagcacatctaaaacttttt<br>agcgttattacgtaaaaaatcttgccagctttccccttctaaagggcaaaagtga<br>gtatggtgcctatctaacatctcaatggctaaggcgtcgagcaaagcccgcttat<br>ttttacatgccaatacaatgtaggctgctctacacctagcttctgggcgagtttac<br>gggttgttaaaccttcgattccgaccttcattaagcagctctaatgcgctgttaatc<br>actttactutatctaatctagacatcattaattcctaattttttgttgacactctatcat<br>tgatagagttattttaccactccctatcagtgatagagaaaagtgaactcta<br>gaaataatttttgtttaactttaagaaggagatatacatATGCGTGCGG<br>TACTGATCGAGAAGTCCGATGATACACAGTCCG<br>TCTCTGTCACCGAACTGGCTGAAGATCAACTGC<br>CGGAAGGCGACGTTTTGGTAGATGTTGCTTATT<br>CAACACTGAACTACAAAGACGCCCTGGCAATTA<br>CCGGTAAAGCCCCCGTCGTTCGTCGTTTTCCGAT<br>GGTACCTGGAATCGACTTTACGGGTACCGTGGC<br>CCAGTCTTCCCACGCCGACTTCAAGCCAGGTGA<br>TCGCGTAATCCTGAATGGTTGGGGTGTGGGGGA<br>AAAACATTGGGGCGGTTTAGCGGAGCGCGCTCG<br>CGTGCGCGGAGACTGGCTTGTTCCCTTGCCAGC<br>CCCCCTGGACTTACGCCAAGCGGCCATGATCGG<br>TACAGCAGGATACACGGCGATGTTGTGCGTTCT<br>GGCGCTTGAACGTCACGGAGTGGTGCCGGGTAA<br>TGGGGAAATCGTGGTGTCCGGTGCAGCAGGCG<br>GCGTCGGCTCCGTTGCGACGACCCTTCTTGCCG<br>CTAAGGGCTATGAGGTAGCGGCAGTGACTGGA<br>CGTGCGTCCGAAGCAGAAATATCTGCGCGGTTTG<br>GGGGCGGCGAGCGTAATTGATCGTAACGAATTA<br>ACGGGGAAGGTACGCCCGCTGGGTCAGGAGCG<br>TTGGGCTGGCGGGATTGACGTGGCGGGATCAAC<br>CGTGCTTGCGAACATGCTTTCTATGATGAAGTA<br>TCGCGGGTAGTCGCTGCGTGTGGCCTGGCCGC<br>GGGCATGGATCTGCCCGCGTCTGTCGCGCCCTT<br>TATTCTTCGTGGGATGACGCTGGCAGGGGTGGA<br>TAGCGTTATGTGCCCAAAGACAGATCGTTTAGC<br>AGCGTGGGCCCGTTTGGCGTCAGATCTTGACCC<br>TGCCAAGCTGGAGGAGATGACTACAGAGTTGCC |

TABLE 46-continued of Exemplary Propionate Cassette Sequences

| Description and SEQ ID NO | Sequence |
|---|---|
| | GTTTAGTGAAGTAATCGAGACAGCACCCAAATT |
| | CTTGGACGGGACGGTTCGTGGCCGCATTGTTAT |
| | CCCCGTAACGCCCTAAga*actctagaaataattttgtttaactta* |
| | *agaaggagatatacat*ATGCGCAAAGTGCCGATTATCA |
| | CGGCTGACGAGGCCGCAAAACTGATCAAGGAC |
| | GGCGACACCGTGACAACTAGCGGCTTTGTGGGT |
| | AACGCGATCCCTGAGGCCCTTGACCGTGCAGTC |
| | GAAAAGCGTTTCCTGGAAACGGGCGAACCGAA |
| | GAACATTACTTATGTATATTGCGGCAGTCAGGG |
| | CAATCGCGACGGTCGTGGCGCAGAACATTTCGC |
| | GCATGAAGGCCTGCTGAAACGTTATATCGCTGG |
| | CCATTGGGCGACCGTCCCGGCGTTAGGGAAAAT |
| | GGCCATGGAGAATAAAATGGAGGCCTACAATG |
| | TCTCTCAGGGCGCCTTGTGTCATCTCTTTCGCGA |
| | TATTGCGAGCCATAAACCGGGTGTGTTCACGAA |
| | AGTAGGAATCGGCACCTTCATTGATCCACGTAA |
| | CGGTGGTGGGAAGGTCAACGATATTACCAAGG |
| | AAGATATCGTAGAACTGGTGGAAATTAAAGGG |
| | CAGGAATACCTGTTTTATCCGGCGTTCCCGATC |
| | CATGTCGCGCTGATTCGTGGCACCTATGCGGAC |
| | GAGAGTGGTAACATCACCTTTGAAAAAGAGGT |
| | AGCGCCTTTGGAAGGGACTTCTGTCTGTCAAGC |
| | GGTGAAGAACTCGGGTGGCATTGTCGTGGTTCA |
| | GGTTGAGCGTGTCGTCAAAGCAGGCACGCTGGA |
| | TCCGCGCCATGTGAAAGTTCCGGGTATCTATGT |
| | AGATTACGTAGTCGTCGCGGATCCGGAGGACCA |
| | TCAACAGTCCCTTGACTGCGAATATGATCCTGC |
| | CCTTAGTGGAGAGCACCGTCGTCCGGAGGTGGT |
| | GGGTGAACCACTGCCTTTATCCGCGAAGAAAGT |
| | CATCGGCCGCCGTGGCGCGATTGAGCTCGAGAA |
| | AGACGTTGCAGTGAACCTTGGGGTAGGTGCACC |
| | TGAGTATGTGGCCTCCGTGGCCGATGAAGAAGG |
| | CATTGTGGATTTTATGACTCTCACAGCGGAGTC |
| | CGGCGCTATCGGTGGCGTTCCAGCCGGCGGTGT |
| | TCGCTTTGGGGCGAGCTACAATGCTGACGCCTT |
| | GATCGACCAGGGCTACCAATTTGATTATTACGA |
| | CGGTGGGGTCTGGATCTTTGTTACCTGGGTTT |
| | AGCTGAATGCGACGAAAAGGGTAATATCAATG |
| | TTAGCCGCTTCGGTCCTCGTATCGCTGGGTGCG |
| | GCGGATTCATTAACATTACCCAAAACACGCCGA |
| | AAGTCTTCTTTTGTGGGACCTTTACAGCCGGGG |
| | GGCTGAAAGTGAAAATTGAAGATGGTAAGGTG |
| | ATTATCGTTCAGGAAGGGAAACAGAAGAAATT |
| | CCTTAAGGCAGTGGAGCAAATCACCTTTAATGG |
| | AGACGTGGCCTTAGCGAACAAGCAACAAGTTA |
| | CCTACATCACGGAGCGTTGCGTCTTCCTCCTCA |
| | AAGAAGACGGTTTACACCTTTCGGAAATCGCGC |
| | CAGGCATCGATCTGCAGACCCAGATTTTGGATG |
| | TTATGGACTTTGCCCCGATCATTGATCGTGACG |
| | CAAACGGGCAGATTAAACTGATGGACGCGGCG |
| | TTATTCGCAGAAGGGCTGATGGGCTTGAAAGAA |
| | ATGAAGTCTTGAtaa*gaaggagatatacat*ATGAGCTTA |
| | ACCCAAGGCATGAAAGCTAAACAACTGTTAGC |
| | ATACTTTCAGGGTAAAGCCGATCAGGATGCACG |
| | TGAAGCGAAAGCCCGCGGTGAGCTGGTCTGCTG |
| | GTCGGCGTCAGTCGCGCCGCCGGAATTTTGCGT |
| | AACAATGGGCATTGCCATGATCTACCCGGAGAC |
| | TCATGCAGCGGGCATCGGTGCCCGCAAAGGTGC |
| | GATGGACATGCTGGAAGTTGCGGACCGCAAAG |
| | GCTACAACGTGGATTGTTGTTCCTACGGCCGTG |
| | TAAATATGGGTTACATGGAATGTTTAAAAGAAG |
| | CCGCCATCACGGGCGTCAAGCCGGAAGTTTTGG |
| | TTAATTCCCCTGCTGCTGACGTTCCGCTTCCCGA |
| | TTTGGTGATTACGTGTAATAATATCTGTAACAC |
| | GCTGCTGAAATGGTACGAAAACTTAGCAGCAG |
| | AACTCGATATTCCTTGCATCGTGATCGACGTAC |
| | CGTTTAATCATACCATGCCGATTCCGGAATATG |
| | CCAAGGCCTACATCGCGGACCAGTTCCGCAATG |
| | CAATTTCTCAGCTGGAAGTTATTGTGGCCGTCC |
| | GTTCGATTGGAAGAAATTTAAGGAGGTCAAAG |
| | ATCAGACCCAGCGTAGCGTATACCACTGGAACC |
| | GCATTGCCGAGATGGCGAAATACAAGCCTAGCC |
| | CGCTGAACGGCTTCGATCTGTTCAATTACATGG |
| | CGTTAATCGTGGCGTGCCGCAGCCTGGATTATG |
| | CAGAAAATTACCTTTAAAGCGTTCGCGGACGAAT |

TABLE 46-continued of Exemplary Propionate Cassette Sequences

| Description and SEQ ID NO | Sequence |
|---|---|
| | TAGAAGAGAATTTGAAGGCGGGTATCTACGCCT<br>TTAAAGGTGCGGAAAAAACGCGCTTTCAATGGG<br>AAGGTATCGCGGTGTGGCCACATTTAGGTCACA<br>CGTTTAAATCTATGAAGAATCTGAATTCGATTA<br>TGACCGGTACGGCATACCCCGCCCTTTGGGACC<br>TGCACTATGACGCTAACGACGAATCTATGCACT<br>CTATGGCTGAAGCGTACACCCGTATTTATATTA<br>ATACTTGTCTGCAGAACAAAGTAGAGGTCCTGC<br>TTGGGATCATGGAAAAAGGCCAGGTGGATGGT<br>ACCGTATATCATCTGAATCGCAGCTGCAAACTG<br>ATGAGTTTCCTGAACGTGGAAACGGCTGAAATT<br>ATTAAAGAGAAGAACGGTCTTCCTTACGTCTCC<br>ATTGATGGCGATCAGACCGATCCTCGCGTTTTTT<br>CTCCGGCCCAGTTTGATACCCGTGTTCAGGCCC<br>TGGTTGAGATGATGGAGGCCAATATGGCGGCA<br>GCGGAATAAtaa*gaaggagatatacat*ATGTCACGCGTG<br>GAGGCAATCCTGTCGCAGCTGAAAGATGTCGCC<br>GCGAATCCGAAAAAAGCCATGGATGACTATAA<br>AGCTGAAACAGGTAAGGGCGCGGTTGGTATCAT<br>GCCGATCTACAGCCCCGAAGAAATGGTACACGC<br>CGCTGGCTATTTGCCGATGGGAATCTGGGGCGC<br>CCAGGGCAAAACGATTAGTAAAGCGCGCACCT<br>ATCTGCCTGCTTTTGCCTGCAGCGTAATGCAGC<br>AGGTTATGGAATTACAGTGCGAGGGCGCGTATG<br>ATGACCTGTCCGCAGTTATTTTTAGCGTACCGTG<br>CGACACTCTCAAATGTCTTAGCCAGAAATGGAA<br>AGGTACGTCCCCAGTGATTGTATTTACGCATCC<br>GCAGAACCGCGGATTAGAAGCGGCGAACCAAT<br>TCTTGGTTACCGAGTATGAACTGGTAAAAGCAC<br>AACTGGAATCAGTTCTGGGTGTGAAAATTTCAA<br>ACGCCGCCCTGGAAAATTCGATTGCAATTTATA<br>ACGAGAATCGTGCCGTGATGCGTGAGTTCGTGA<br>AAGTGGCAGCGGACTATCCTCAAGTCATTGACG<br>CAGTGAGCCGCCACGCGGTTTTTAAAGCGCGCC<br>AGTTTATGCTTAAGGAAAAACATACCGCACTTG<br>TGAAAGAACTGATCGCTGAGATTAAAGCAACG<br>CCAGTCCAGCCGTGGGACGGAAAAAAGGTTGT<br>AGTGACGGGCATTCTGTTGGAACCGAATGAGTT<br>ATTAGATATCTTTAATGAGTTTAAGATCGCGAT<br>TGTTGATGATGATTTAGCGCAGGAAAGCCGTCG<br>GATCCGTGTTGACGTTCTGGACGGAGAAGGCGG<br>ACCGCTCTACCGTATGGCTAAAGCGTGGCAGCA<br>AATGTATGGCTGCTCGCTGGCAACCGACACCAA<br>GAAGGGTCGCGGCCGTATGTTAATTAACAAAC<br>GATTCAGACCGGTGCGGACGCTATCGTAGTTGC<br>AATGATGAAGTTTTGCGACCCAGAAGAATGGG<br>ATTATCCGGTAATGTACCGTGAATTTGAAGAAA<br>AAGGGGTCAAATCACTTATGATTGAGGTGGATC<br>AGGAAGTATCGTCTTTCGAACAGATTAAAACCC<br>GTCTGCAGTCATTCGTCGAAATGCTTTAAtaa*gaag*<br>*gagatatacat*ATGTATACCTTGGGGATTGATGTCGG<br>TTCTGCCTCTAGTAAAGCGGTGATTCTGAAAGA<br>TGGAAAAGATATTGTCGCTGCCGAGGTTGTCCA<br>AGTCGGTACCGGCTCCTCGGGTCCCCAACGCGC<br>ACTGGACAAAGCCTTTGAAGTCTCTGGCTTAAA<br>AAAGGAAGACATCAGCTACACAGTAGCTACGG<br>GCTATGGGCGCTTCAATTTTAGCGACGCGGATA<br>AACAGATTTCGGAAATTAGCTGTCATGCCAAAG<br>GCATTTATTTCTTAGTACCAACTGCGCGCACTAT<br>TATTGACATTGGCGGCCAAGATGCGAAAGCCAT<br>CCGCCTGGACGACAAGGGGGGTATTAAGCAATT<br>CTTCATGAATGATAAATGCGCGGCGGGCACGGG<br>GCGTTTCCTGGAAGTCATGGCTCGCGTACTTGA<br>AACCACCCTGGATGAAATGGCTGAACTGGATGA<br>ACAGGCGACTGACACCGCTCCCATTTCAAGCAC<br>CTGCACGGTTTTCGCCGAAAGCGAAGTAATTAG<br>CCAATTGAGCAATGGTGTCTCACGCAACAACAT<br>CATTAAAGGTGTCCATCTGAGCGTTGCGTCACG<br>TGCGTGTGGTCTGGCGTATCGCGGCGGTTTGGA<br>GAAAGATGTTGTTATGACAGGTGGCGTGGCAAA<br>AAATGCAGGGGTGGTGCGCGCGGTGGCGGGCG<br>TTCTGAAGACCGATGTTATCGTTGCTCCGAATC<br>CTCAGACGACCGGTGCACTGGGGGCAGCGCTGT<br>ATGCTTATGAGGCCGCCCAGAAGAAGTAgatggtag<br>tgtggggtctccccatgcgagagtagggaactgccaggcatcaaataaac |

TABLE 46-continued of Exemplary Propionate Cassette Sequences

| Description and SEQ ID NO | Sequence |
|---|---|
| | *gaaaggctcagtcgaaagactgggcctttcgttttatctgttgtttg cgctctcctgagtaggacaaat*ccgccgggagcggatttgaacgagcgaag caacggcccggagggtggcgggcaggacgcccgccataaactgccaggca tcaaattaagc*agaaggccatccgacggatggccttt* |
| acuI-pct-lcdABC (SEQ ID NO: 222) | ATGCGTGCGGTACTGATCGAGAAGTCCGATGAT ACACAGTCCGTCTCTGTCACCGAACTGGCTGAA GATCAACTGCCGGAAGGCGACGTTTTGGTAGAT GTTGCTTATTCAACACTGAACTACAAAGACGCC CTGGCAATTACCGGTAAAGCCCCCGTCGTTCGT CGTTTTCCGATGGTACCTGGAATCGACTTTACG GGTACCGTGGCCCAGTCTTCCCACGCCGACTTC AAGCCAGGTGATCGCGTAATCCTGAATGGTTGG GGTGTGGGGAAAAACATTGGGGCGGTTTAGC GGAGCGCGCTCGCGTGCGCGGAGACTGGCTTGT TCCCTTGCCAGCCCCCCTGGACTTACGCCAAGC GGCCATGATCGGTACAGCAGGATACACGGCGA TGTTGTGCGTTCTGGCGCTTGAACGTCACGGAG TGGTGCCGGGTAATGGGGAAATCGTGGTGTCCG GTGCAGCAGGCGGCGTCGGCTCCGTTGCGACGA CCCTTCTTGCCGCTAAGGGCTATGAGGTAGCGG CAGTGACTGGACGTGCGTCCGAAGCAGAATATC TGCGCGGTTTGGGGGCGGCGAGCGTAATTGATC GTAACGAATTAACGGGGAAGGTACGCCCGCTG GGTCAGGAGCGTTGGGCTGGCGGGATTGACGTG GCGGGATCAACCGTGCTTGCGAACATGCTTTCT ATGATGAAGTATCGCGGGGTAGTCGCTGCGTGT GGCCTGGCCGCGGGCATGGATCTGCCCGCGTCT GTCGCGCCCTTTATTCTTCGTGGGATGACGCTG GCAGGGGTGGATAGCGTTATGTGCCCAAAGAC AGATCGTTTAGCAGCGTGGGCCCGTTTGGCGTC AGATCTTGACCCTGCCAAGCTGGAGGAGATGAC TACAGAGTTGCCGTTTAGTGAAGTAATCGAGAC AGCACCCAAATTCTTGGACGGGACGGTTCGTGG CCGCATTGTTATCCCCGTAACGCCCTAAgaa*ctctag aaataattttgtttaactttaagaaggagatatacat*ATGCGCAAAG TGCCGATTATCACGGCTGACGAGGCCGCAAAAC TGATCAAGGACGGCGACACCGTGACAACTAGC GGCTTTGTGGGTAACGCGATCCCTGAGGCCCTT GACCGTGCAGTCGAAAAGCGTTTCCTGGAAACG GGCGAACCGAAGAACATTACTTATGTATATTGC GGCAGTCAGGGCAATCGCGACGGTCGTGGCGC AGAACATTTCGCGCATGAAGGCCTGCTGAAACG TTATATCGCTGGCCATTGGGCGACCGTCCCGGC GTTAGGGAAAATGGCCATGGAGAATAAAATGG AGGCCTACAATGTCTCTCAGGGCGCCTTGTGTC ATCTCTTTCGCGATATTGCGAGCCATAAACCGG GTGTGTTCACGAAAGTAGGAATCGGCACCTTCA TTGATCCACGTAACGGTGGTGGGAAGGTCAACG ATATTACCAAGGAAGATATCGTAGAACTGGTGG AAATTAAAGGGCAGGAATACCTGTTTTATCCGG CGTTCCCGATCCATGTCGCGCTGATTCGTGGCA CCTATGCGGACGAGAGTGGTAACATCACCTTTG AAAAAGAGGTAGCGCCTTTGGAAGGGACTTCTG TCTGTCAAGCGGTGAAGAACTCGGGTGGCATTG TCGTGGTTCAGGTTGAGCGTGTCGTCAAAGCAG GCACGCTGGATCCGCGCCATGTGAAAGTTCCGG GTATCTATGTAGATTACGTAGTCGTCGCGGATC CGGAGGACCATCAACAGTCCCTTGACTGCGAAT ATGATCCTGCCCTTAGTGGAGAGCACCGTCGTC CGGAGGTGGTGGGTGAACCACTGCCTTTATCCG CGAAGAAAGTCATCGGCCGCCGTGGCGCGATTG AGCTCGAGAAAGACGTTGCAGTGAACCTTGGG GTAGGTGCACCTGAGTATGTGGCCTCCGTGGCC GATGAAGAAGGCATTGTGGATTTTATGACTCTC ACAGCGGAGTCCGGCGCTATCGGTGGCGTTCCA GCCGGCGGTGTTCGCTTTGGGGCGAGCTACAAT GCTGACGCCTTGATCGACCAGGGCTACCAATTT GATTATTACGACGGTGGGGGTCTGGATCTTTGT TACCTGGGTTTAGCTGAATGCGACGAAAAGGGT AATATCAATGTTAGCCGCTTCGGTCCTCGTATC GCTGGGTGCGGCGGATTCATTAACATTACCCAA AACACGCCGAAAGTCTTCTTTTGTGGGACCTTT ACAGCCGGGGGCTGAAAGTGAAAATTGAAGA TGGTAAGGTGATTATCGTTCAGGAAGGGAAACA TABLE 46-continued of Exemplary Propionate Cassette Sequences

| Description and SEQ ID NO | Sequence |
|---|---|
| | GAAGAAATTCCTTAAGGCAGTGGAGCAAATCA<br>CCTTTAATGGAGACGTGGCCTTAGCGAACAAGC<br>AACAAGTTACCTACATCACGGAGCGTTGCGTCT<br>TCCTCCTCAAAGAAGACGGTTTACACCTTTCGG<br>AAATCGCGCCAGGCATCGATCTGCAGACCCAGA<br>TTTTGGATGTTATGGACTTTGCCCCGATCATTGA<br>TCGTGACGCAAACGGGCAGATTAAACTGATGG<br>ACGCGGCGTTATTCGCAGAAGGGCTGATGGGCT<br>TGAAAGAAATGAAGTCTTGAtaa*gaaggagatatacat*A<br>TGAGCTTAACCCAAGGCATGAAAGCTAAACAA<br>CTGTTAGCATACTTTCAGGGTAAAGCCGATCAG<br>GATGCACGTGAAGCGAAAGCCCGCGGTGAGCT<br>GGTCTGCTGGTCGGCGTCAGTCGCGCCGCCGGA<br>ATTTTGCGTAACAATGGGCATTGCCATGATCTA<br>CCCGGAGACTCATGCAGCGGGCATCGGTGCCCG<br>CAAAGGTGCGATGGACATGCTGGAAGTTGCGG<br>ACCGCAAAGGCTACAACGTGGATTGTTGTTCCT<br>ACGGCCGTGTAAATATGGGTTACATGGAATGTT<br>TAAAAGAAGCCGCCATCACGGGCGTCAAGCCG<br>GAAGTTTTGGTTAATTCCCCTGCTGCTGACGTTC<br>CGCTTCCCGATTTGGTGATTACGTGTAATAATAT<br>CTGTAACACGCTGCTGAAATGGTACGAAAACTT<br>AGCAGCAGAACTCGATATTCCTTGCATCGTGAT<br>CGACGTACCGTTTAATCATACCATGCCGATTCC<br>GGAATATGCCAAGGCCTACATCGCGGACCAGTT<br>CCGCAATGCAATTTCTCAGCTGGAAGTTATTTG<br>TGGCCGTCCGTTCGATTGGAAGAAATTTAAGGA<br>GGTCAAAGATCAGACCCAGCGTAGCGTATACCA<br>CTGGAACCGCATTGCCGAGATGGCGAAATACA<br>AGCCTAGCCCGCTGAACGGCTTCGATCTGTTCA<br>ATTACATGGCGTTAATCGTGGCGTGCCGCAGCC<br>TGGATTATGCAGAAATTACCTTTAAAGCGTTCG<br>CGGACGAATTAGAAGAGAATTTGAAGGCGGGT<br>ATCTACGCCTTTAAAGGTGCGGAAAAAACGCGC<br>TTTCAATGGGAAGGTATCGCGGTGTGGCCACAT<br>TTAGGTCACACGTTTAAATCTATGAAGAATCTG<br>AATTCGATTATGACCGGTACGGCATACCCCGCC<br>CTTTGGGACCTGCACTATGACGCTAACGACGAA<br>TCTATGCACTCTATGGCTGAAGCGTACACCCGT<br>ATTTATATTAATACTTGTCTGCAGAACAAAGTA<br>GAGGTCCTGCTTGGGATCATGGAAAAAGGCCA<br>GGTGGATGGTACCGTATATCATCTGAATCGCAG<br>CTGCAAACTGATGAGTTTCCTGAACGTGGAAAC<br>GGCTGAAATTATTAAAGAGAAGAACGGTCTTCC<br>TTACGTCTCCATTGATGGCGATCAGACCGATCC<br>TCGCGTTTTTTCTCCGGCCCAGTTTGATACCCGT<br>GTTCAGGCCCTGGTTGAGATGATGGAGGCCAAT<br>ATGGCGGCAGCGGAATAAtaa*gaaggagatatacat*ATG<br>TCACGCGTGGAGGCAATCCTGTCGCAGCTGAAA<br>GATGTCGCCGCGAATCCGAAAAAAGCCATGGA<br>TGACTATAAAGCTGAAACAGGTAAGGGCGCGG<br>TTGGTATCATGCCGATCTACAGCCCCGAAGAAA<br>TGGTACACGCCGCTGGCTATTTGCCGATGGGAA<br>TCTGGGGCGCCCAGGGCAAAACGATTAGTAAA<br>GCGCGCACCTATCTGCCTGCTTTTGCCTGCAGC<br>GTAATGCAGCAGGTTATGGAATTACAGTGCGAG<br>GGCGCGTATGATGACCTGTCCGCAGTTATTTTT<br>AGCGTACCGTGCGACACTCTCAAATGTCTTAGC<br>CAGAAATGGAAAGGTACGTCCCCAGTGATTGTA<br>TTTACGCATCCGCAGAACCGCGGATTAGAAGCG<br>GCGAACCAATTCTTGGTTACCGAGTATGAACTG<br>GTAAAAGCACAACTGGAATCAGTTCTGGGTGTG<br>AAAATTTCAAACGCCGCCCTGGAAAATTCGATT<br>GCAATTTATAACGAGAATCGTGCCGTGATGCGT<br>GAGTTCGTGAAAGTGGCAGCGGACTATCCTCAA<br>GTCATTGACGCAGTGAGCCGCCACGCGGTTTTT<br>AAAGCGCGCCAGTTTATGCTTAAGGAAAAACAT<br>ACCGCACTTGTGAAAGAACTGATCGCTGAGATT<br>AAAGCAACGCCAGTCCAGCCGTGGGACGGAAA<br>AAAGGTTGTAGTGACGGGCATTCTGTTGGAACC<br>GAATGAGTTATTAGATATCTTTAATGAGTTTAA<br>GATCGCGATTGTTGATGATGATTTAGCGCAGGA<br>AAGCCGTCGGATCCGTGTTGACGTTCTGGACGG<br>AGAAGGCGGACCGCTCTACCGTATGGCTAAAGC<br>GTGGCAGCAAATGTATGGCTGCTCGCTGGCAAC |

TABLE 46-continued of Exemplary Propionate Cassette Sequences

| Description and SEQ ID NO | Sequence |
|---|---|
| | CGACACCAAGAAGGGTCGCGGCCGTATGTTAAT<br>TAACAAAACGATTCAGACCGGTGCGGACGCTAT<br>CGTAGTTGCAATGATGAAGTTTTGCGACCCAGA<br>AGAATGGGATTATCCGGTAATGTACCGTGAATT<br>TGAAGAAAAAGGGGTCAAATCACTTATGATTGA<br>GGTGGATCAGGAAGTATCGTCTTTCGAACAGAT<br>TAAAACCCGTCTGCAGTCATTCGTCGAAATGCT<br>TTAAtaa*gaaggagatatacat*ATGTATACCTTGGGGATT<br>GATGTCGGTTCTGCCTCTAGTAAAGCGGTGATT<br>CTGAAAGATGGAAAAGATATTGTCGCTGCCGAG<br>GTTGTCCAAGTCGGTACCGGCTCCTCGGGTCCC<br>CAACGCGCACTGGACAAAGCCTTTGAAGTCTCT<br>GGCTTAAAAAAGGAAGACATCAGCTACACAGT<br>AGCTACGGGCTATGGGCGCTTCAATTTTAGCGA<br>CGCGGATAAACAGATTTCGGAAATTAGCTGTCA<br>TGCCAAAGGCATTTATTTCTTAGTACCAACTGC<br>GCGCACTATTATTGACATTGGCGGCCAAGATGC<br>GAAAGCCATCCGCCTGGACGACAAGGGGGGTA<br>TTAAGCAATTCTTCATGAATGATAAATGCGCGG<br>CGGGCACGGGGCGTTTCCTGGAAGTCATGGCTC<br>GCGTACTTGAAACCACCCTGGATGAAATGGCTG<br>AACTGGATGAACAGGCGACTGACACCGCTCCCA<br>TTTCAAGCACCTGCACGGTTTTCGCCGAAAGCG<br>AAGTAATTAGCCAATTGAGCAATGGTGTCTCAC<br>GCAACAACATCATTAAAGGTGTCCATCTGAGCG<br>TTGCGTCACGTGCGTGTGGTCTGGCGTATCGCG<br>GCGGTTTGGAGAAAGATGTTGTTATGACAGGTG<br>GCGTGGCAAAAAATGCAGGGGTGGTGCGCGCG<br>GTGGCGGGCGTTCTGAAGACCGATGTTATCGTT<br>GCTCCGAATCCTCAGACGACCGGTGCACTGGGG<br>GCAGCGCTGTATGCTTATGAGGCCGCCCAGAAG<br>AAGTA |

Example 27. Quantification of Propionate by LC-MS/MS

Sample Preparation

First, fresh 1000, 500, 250, 100, 20, 4 and 0.8 μg/mL sodium propionate standards were prepared in water. Then, 25 μL of sample (bacterial supernatants and standards) were pipetted into a V-bottom polypropylene 96-well plate, and 75 μL of 60% ACN (45 uL ACN+30 uL water per reaction) with 10 ug/mL of butyrate-d5 (CDN isotope) internal standard in final solution were added to each sample. The plate was heat-sealed, mixed well, and centrifuged at 4000 rpm for 5 minutes. In a round-bottom 96-well polypropylene plate, 5 μL of diluted samples were added to 95 μL of a buffer containing 10 mM MES pH4.5, 20 mM EDC (N-(3-Dimethylaminopropyl)-N'-ethylcarbodiimide), and 20 mM TFEA (2,2,2-trifluroethylamine). The plate was again heat-sealed and mixed well, and samples were incubated at room temperature for 1 hour LC-MS/MS method Propionate was measured by liquid chromatography coupled to tandem mass spectrometry (LC-MS/MS) using a Thermo TSQ Quantum Max triple quadrupole mass spectrometer. HPLC Details are listed in Table 47 and Table 48. Tandem Mass Spectrometry details are found in Table 49.

TABLE 47

HPLC Details

| | |
|---|---|
| Column | Thermo Aquasil C18 column, 5 μm (50 × 2.1 mm) |
| Mobile Phase A | 100% H2O, 0.1% Formic Acid |
| Mobile Phase B | 100% ACN, 0.1% Formic Acid |
| Injection volume | 10 uL |

TABLE 48

HPLC Method

| Total Time (min) | Flow Rate (μL/min) | A % | B % |
|---|---|---|---|
| 0 | 0.5 | 100 | 0 |
| 1 | 0.5 | 100 | 0 |
| 2 | 0.5 | 10 | 90 |
| 4 | 0.5 | 10 | 90 |
| 4.01 | 0.5 | 100 | 0 |
| 4.25 | 0.5 | 100 | 0 |

TABLE 49

Tandem Mass Spectrometry Details

| Ion Source | HESI-II |
|---|---|
| Polarity | Positive |
| SRM transitions | Propionate |
| | 156.2/57.1, |
| | Propionate-d5 |
| | 161/62.1 |

Figure 21:
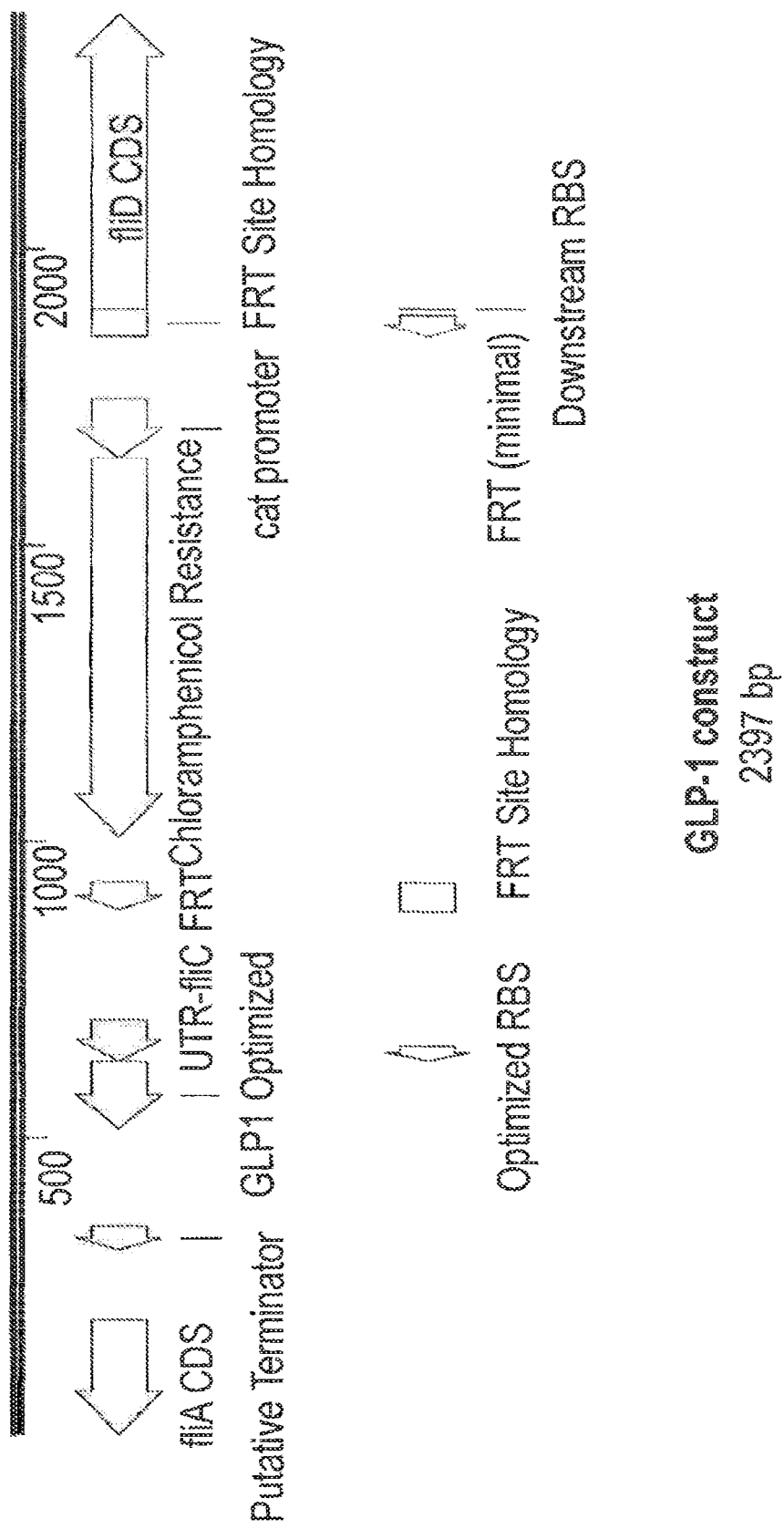
FIG. 21 depicts a schematic of a construct comprising GLP-1 (1-37) under the control of the FliC promoter and 5'UTR containing the N-terminal flagellar secretion signal for secretion.
Figure 22:
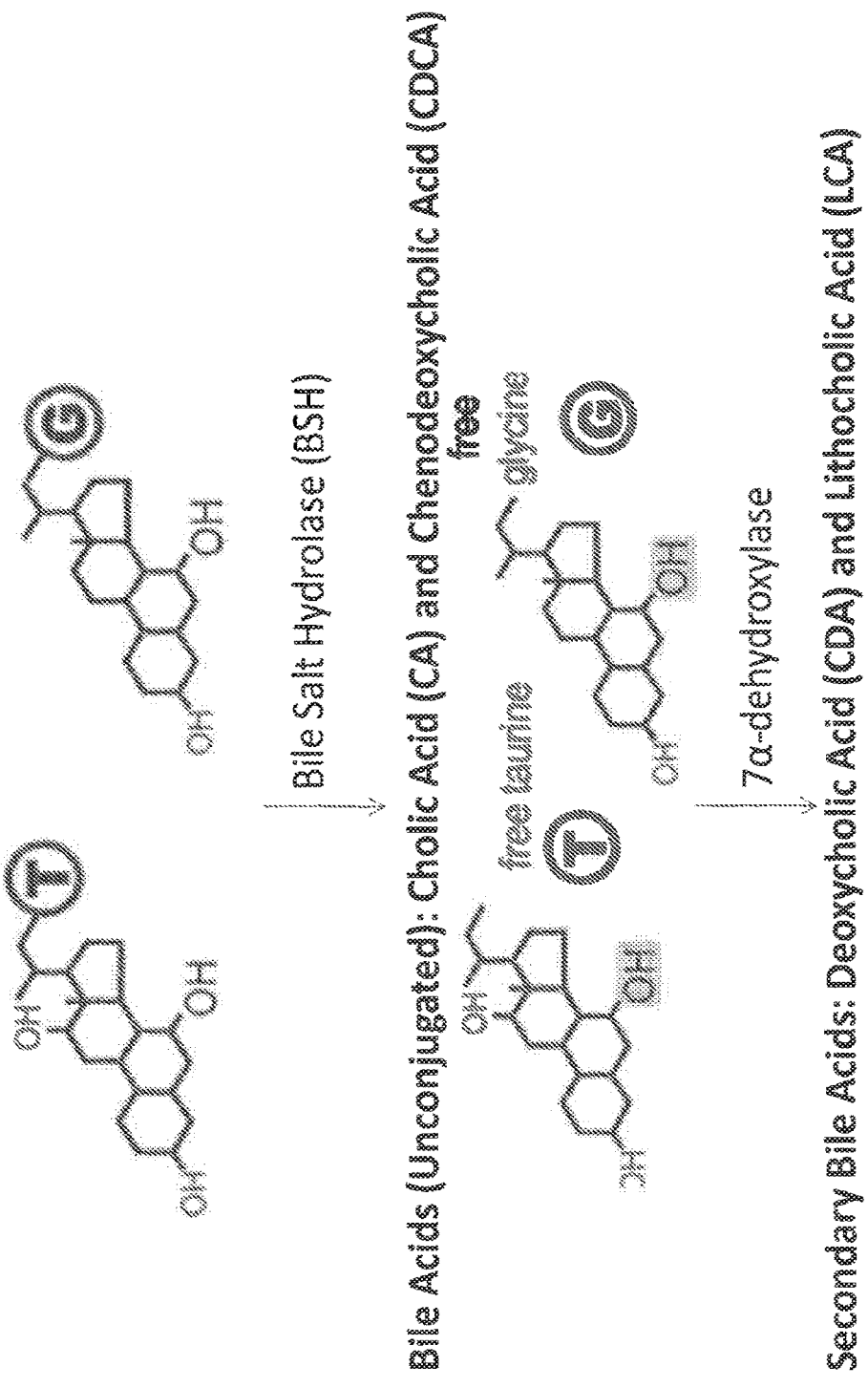
FIG. 22 depicts bile salt metabolism. Bile salts are synthesized from cholesterol in the liver and stored in the gallbladder. After release into the duodenum, microbial bile salt hydrolase activity in the small intestine deconjugates the glycine or taurine molecules to produce primary bile acids (also known as unconjugated bile acids). Most bile acids are reabsorbed into the enterohepatic portal system, but some enter the large intestine where they are further metabolized by microbial 7α-dehydroxylase to produce secondary bile acids. Excess bile acids are also lost in the stool (200 mg-600 mg per day).
Figure 23:
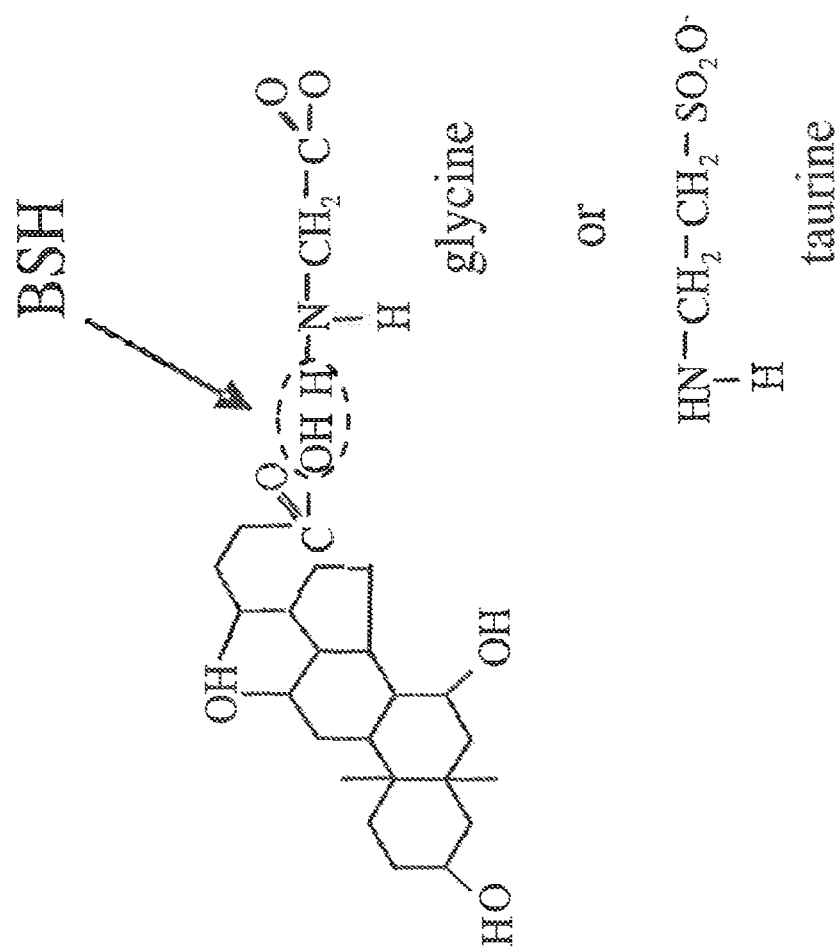
FIG. 23 depicts the structure of bile salts and the location at which bile salt hydrolase enzymes deconjugate the bile salts. BSH activity has been detected in *Lactobacillus* spp, *Bifidobacterium* spp, *Enterococcus* spp, *Clostridium* spp, and *Bacteroides* spp. BSH positive bacteria are gram positive with the exception of two *Bacteroides* strains. BSH in has been detected in pathogenic bacteria, e.g., *Listeria monocytogenes* and *Enterococcus feacalis*. *E. coli* does not demonstrate BSH actvity nor contain bsh homolog in genome
Figure 24:
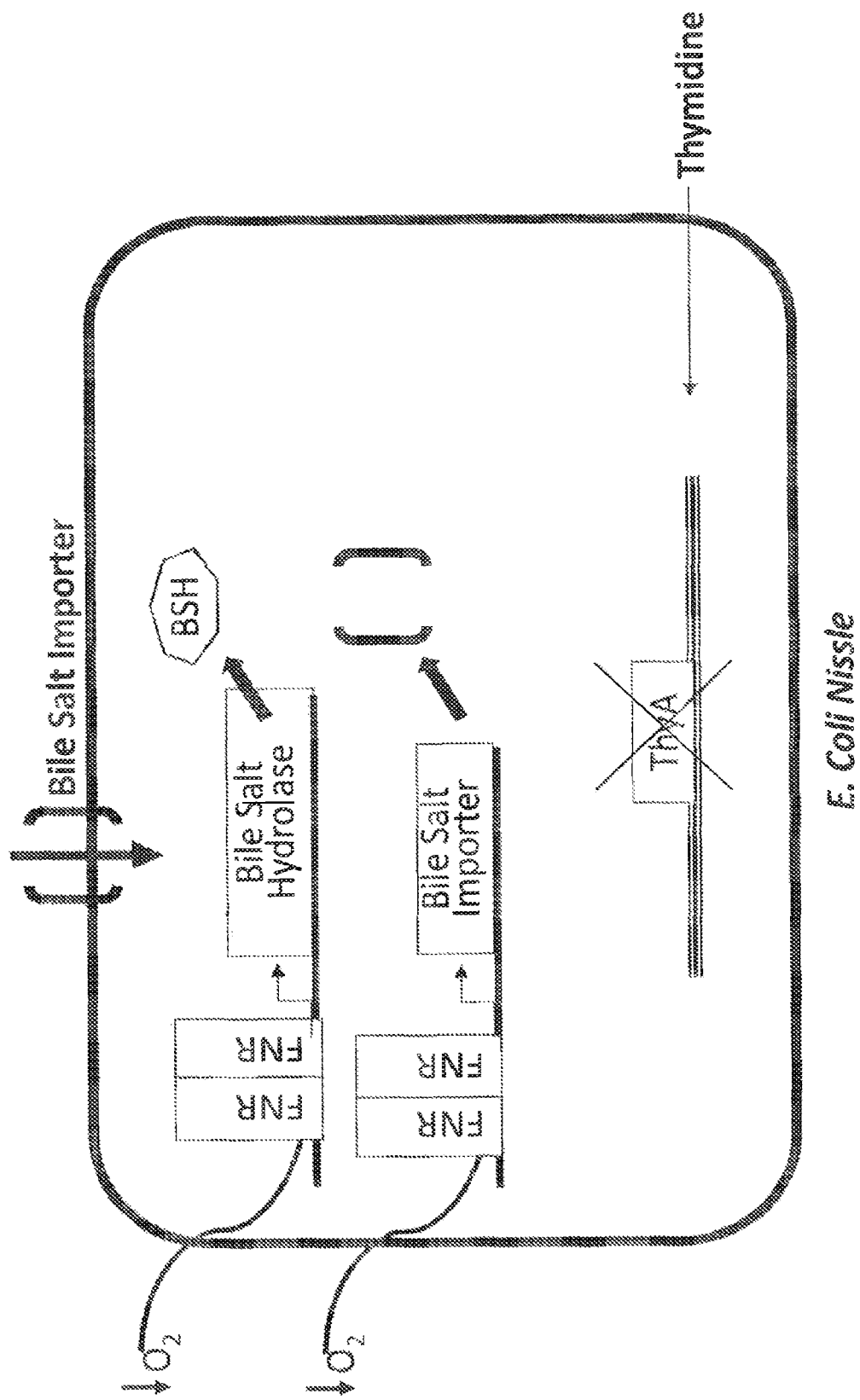
FIG. 24 depicts the state of one non-limiting embodiment of the bile salt hydrolase enzyme construct under inducing conditions. Expression of the bile salt hydrolase enzyme and a bile salt transporter are both induced by the FNR promoter in the absence of oxygen. The thyA gene has been mutated in the *E. coli* Nissle genome, so thymidine must be supplied in the culture medium to support growth. The recombinant bacterial cell may further comprise an auxotrophic mutation, a type III secretion system, and/or a kill switch, as further described herein.
Figure 25:
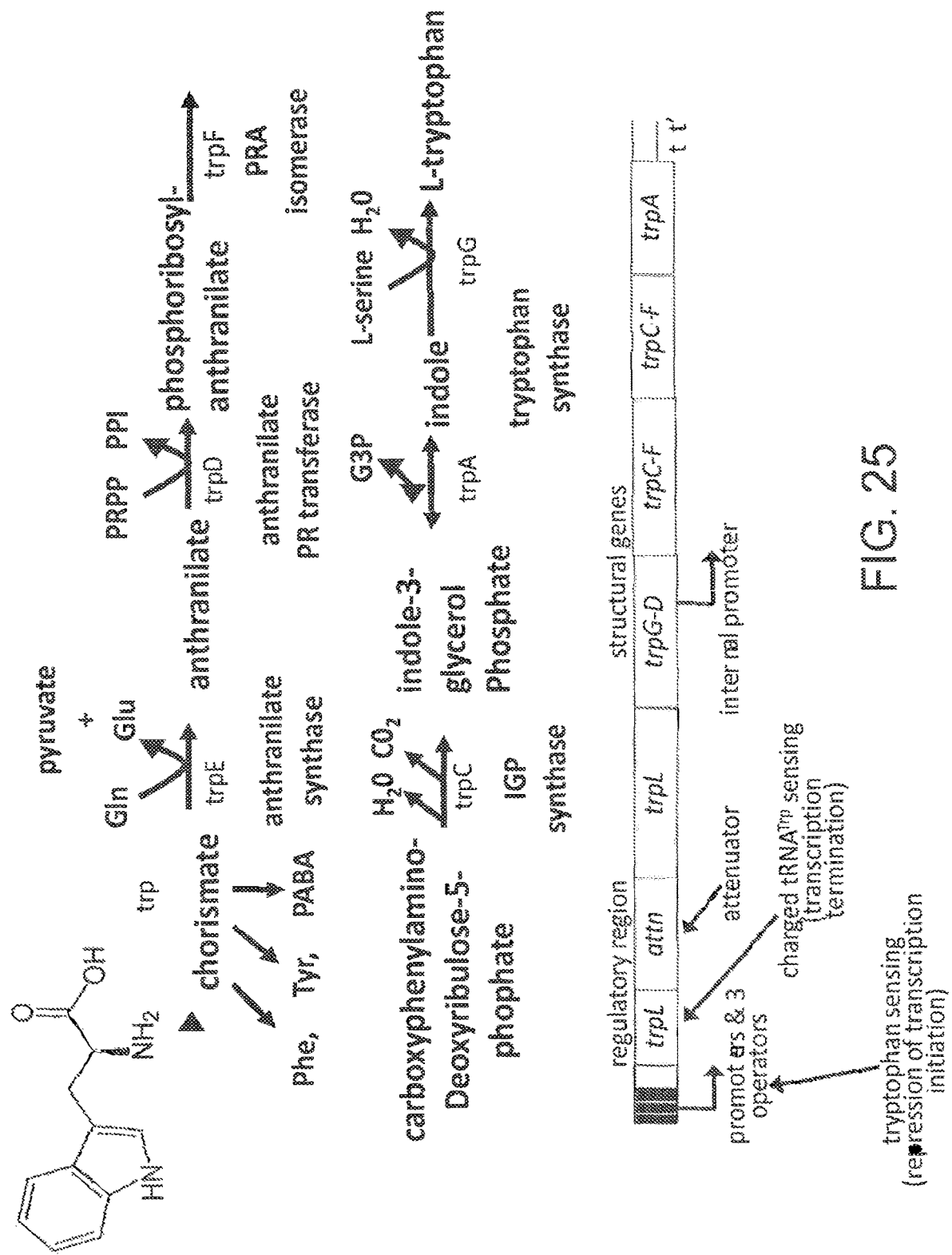
FIG. 25 depicts schematic of the *E. coli* tryptophan synthesis pathway, including genes, enzymes, and reactions involved. The seven genes, or genetic segments, seven enzymes, or enzyme domains, and seven reactions, involved in tryptophan formation are shown. Only one of the reactions is reversible. The products of four other pathways contribute carbon and/or nitrogen during tryptophan formation. Two of the tryptophan pathway enzymes often function as polypeptide complexes: anthranilate synthase, consisting of the TrpG and TrpE polypeptides, and tryptophan synthase, consisting of the TrpB and TrpA polypeptides.
Figure 26:
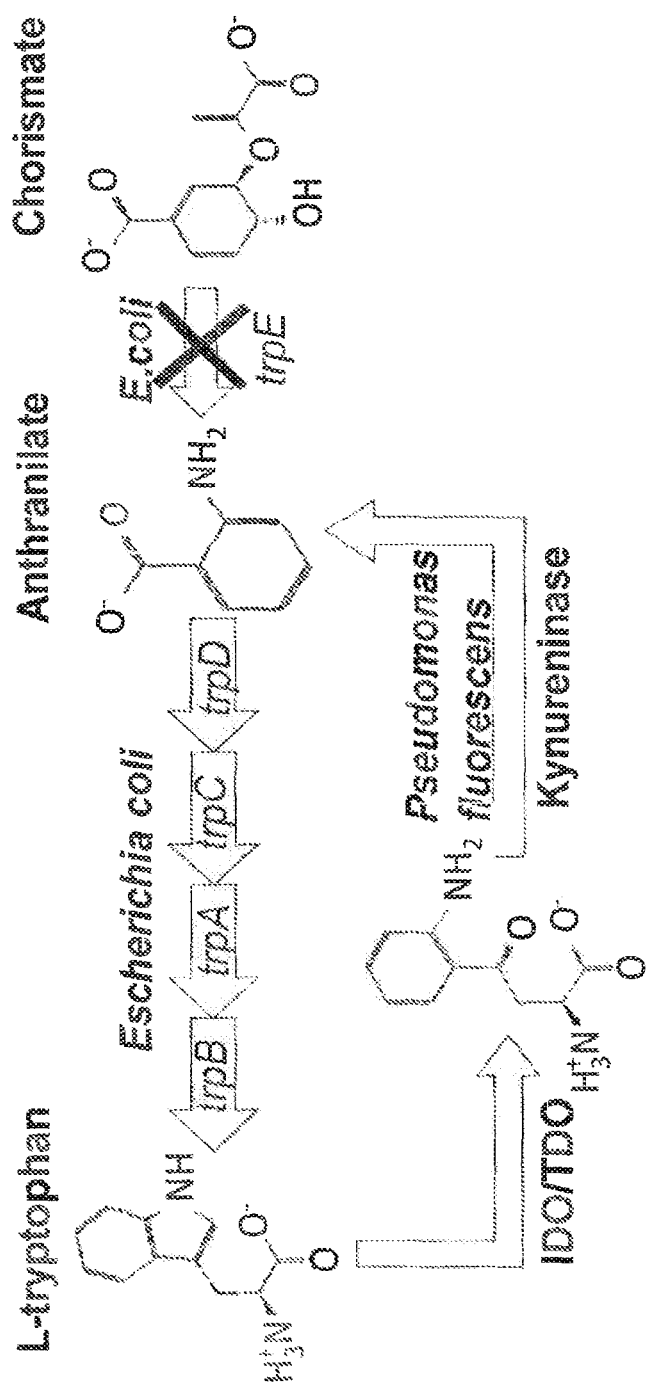
FIG. 26 depicts a schematic of one embodiment of the disclosure. In this embodiment, tryptophan is synthesized from kynurenine. Through this conversion, a kynurenine can be removed from the external environment, and tryptophan is generated. Kynureninase from *Pseudomonas fluorescens* converts KYN to AA (Anthranillic acid), which then can be converted to tryptophan through the enzymes of the *E. coli* trp operon. Optionally, the trpE gene may be deleted as it is not needed for the generation of tryptophan from kynurenine. In alternate embodiments, the trpE gene is not deleted, in order to maximize tryptophan production by using both kynurenine and chorismate as a substrate. In some embodiments, a new strain is generated through adaptive laboratory evolution. The ability of this strain to metabolize kynurenine is improved (through lowering of kynurenine substrate). Additionally, the ability or preference of the strain take up tryptophan is lowered (due to selection pressure imposed by toxic tryptophan analogs. As a result, this strain has improved therapeutic properties in a number of applications, including but not limited to immunoncology.
Figure 51:
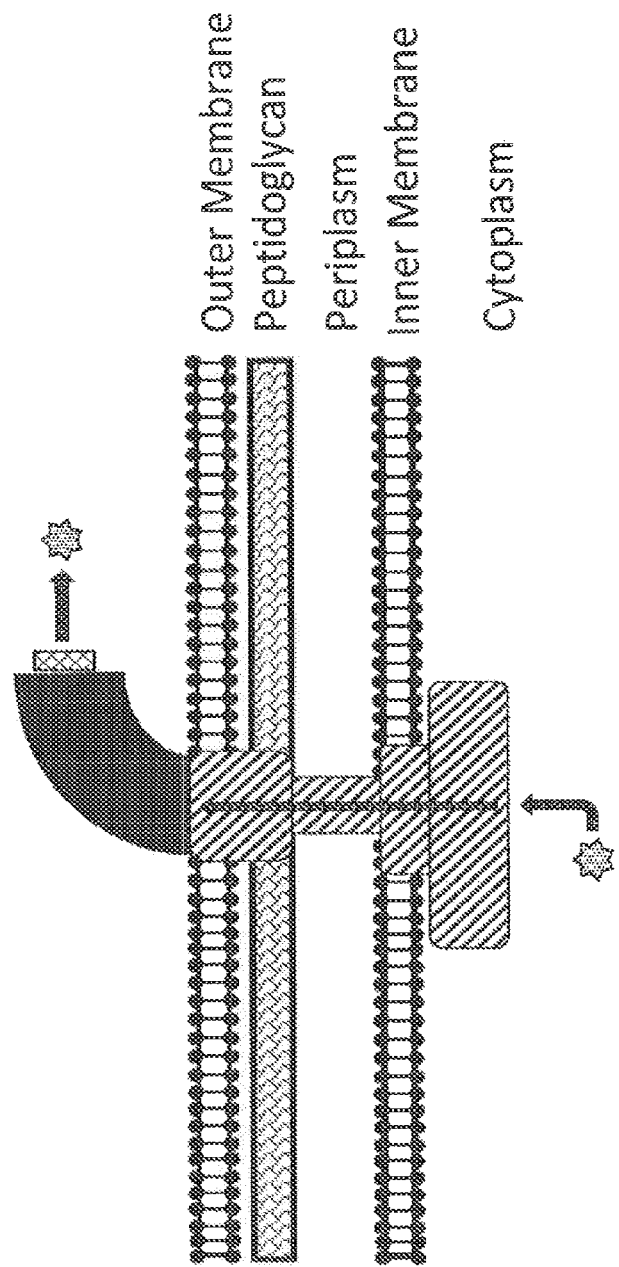
FIG. 51 depicts a schematic of a secretion system based on the flagellar type III secretion in which an incomplete flagellum is used to secrete a therapeutic peptide of interest (star) by recombinantly fusing the peptide to an N-terminal flagellar secretion signal of a native flagellar component so that the intracellularly expressed chimeric peptide can be mobilized across the inner and outer membranes into the surrounding host environment.
Figure 52:
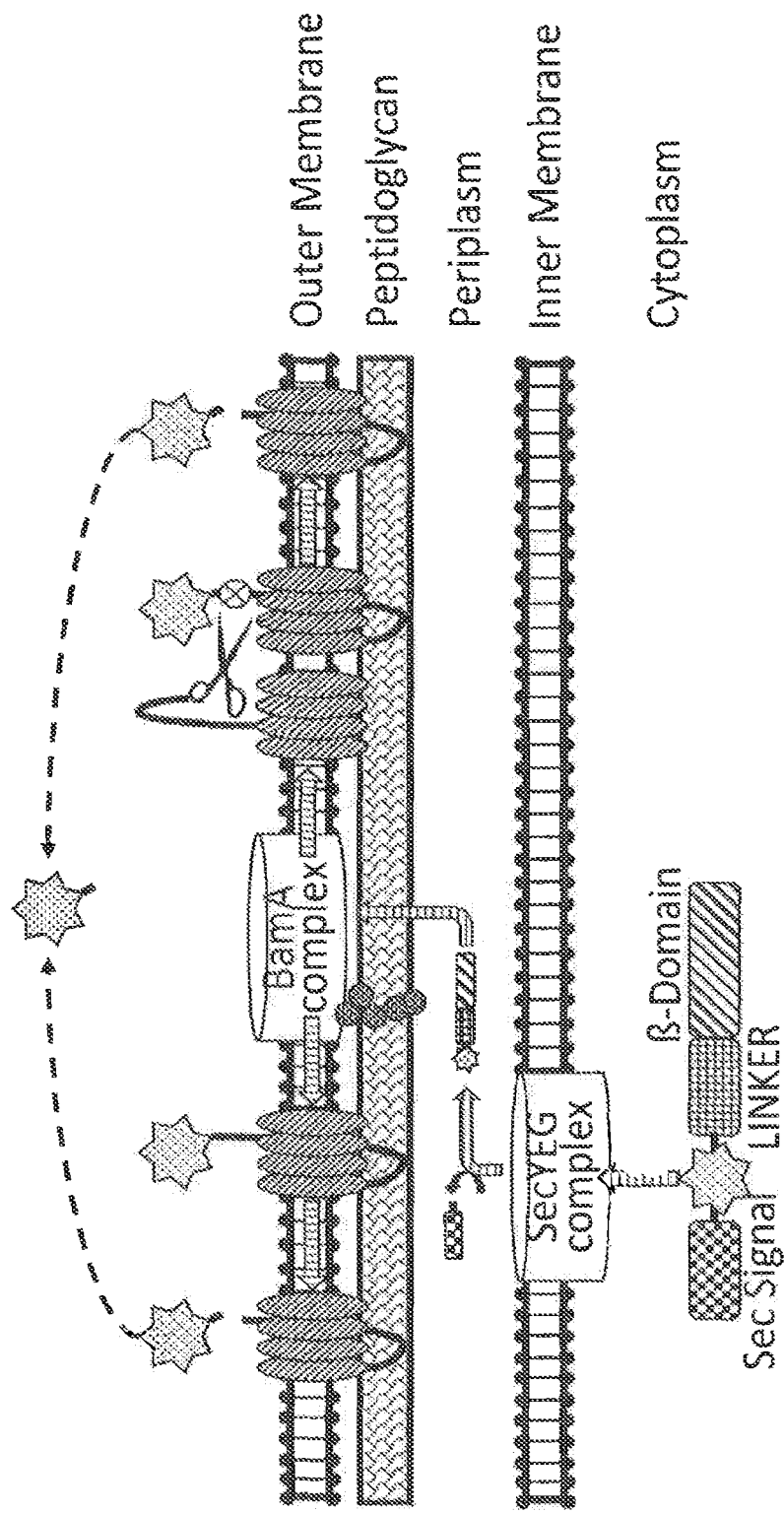
FIG. 52 depicts a schematic of a type V secretion system for the extracellular production of recombinant proteins in which a therapeutic peptide (star) can be fused to an N-terminal secretion signal, a linker and the beta-domain of an autotransporter. In this system, the N-terminal signal sequence directs the protein to the SecA-YEG machinery which moves the protein across the inner membrane into the periplasm, followed by subsequent cleavage of the signal sequence. The beta-domain is recruited to the Bam complex where the beta-domain is folded and inserted into the outer membrane as a beta-barrel structure. The therapeutic peptide is then thread through the hollow pore of the beta-barrel structure ahead of the linker sequence. The therapeutic peptide is freed from the linker system by an autocatalytic cleavage or by targeting of a membrane-associated peptidase (scissors) to a complementary protease cut site in the linker.
Figure 53:
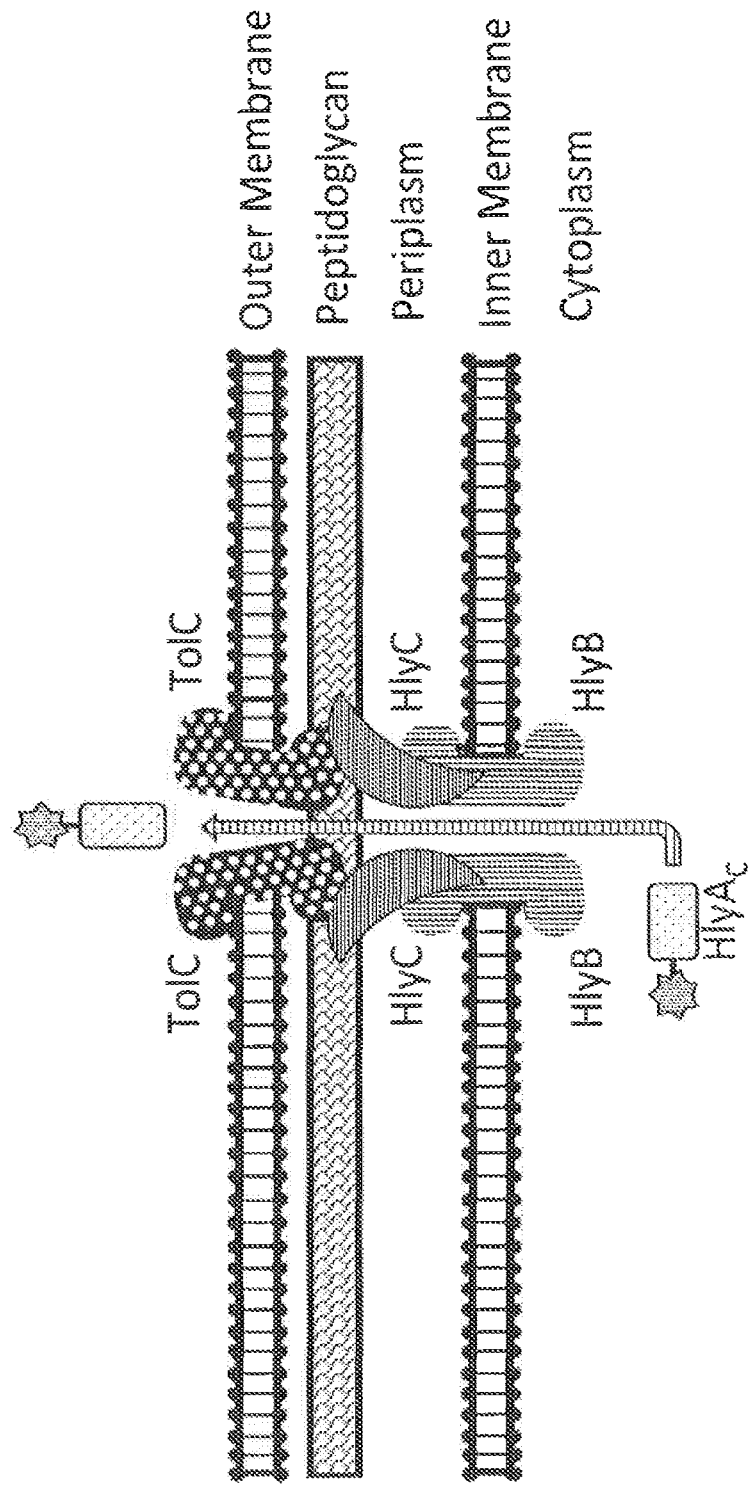
FIG. 53 depicts a schematic of a type I secretion system, which translocates a passenger peptide directly from the cytoplasm to the extracellular space using HlyB (an ATP-binding cassette transporter); HlyD (a membrane fusion protein); and TolC (an outer membrane protein) which form a channel through both the inner and outer membranes. The secretion signal-containing C-terminal portion of HlyA is fused to the C-terminal portion of a therapeutic peptide (star) to mediate secretion of this peptide.
Figure 54:
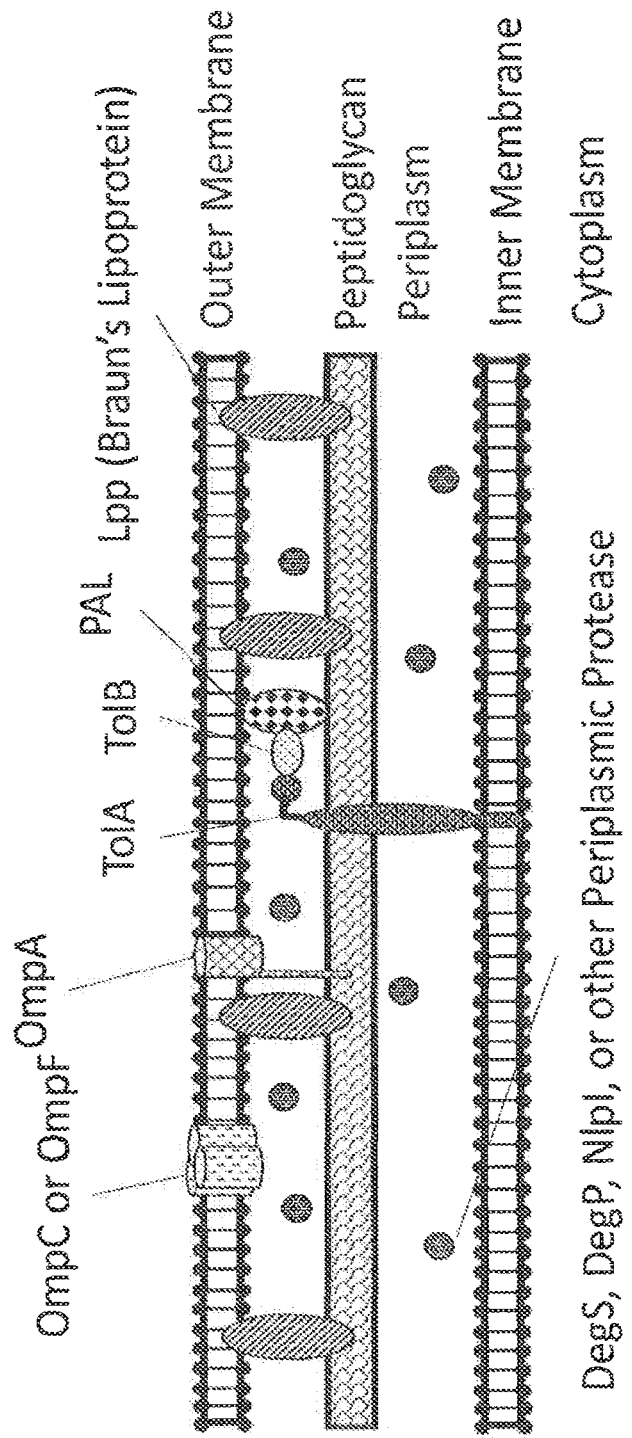
FIG. 54 depicts a schematic of the outer and inner membranes of a gram-negative bacterium, and several deletion targets for generating a leaky or destabilized outer membrane, thereby facilitating the translocation of a therapeutic polypeptides to the extracellular space, e.g., therapeutic polypeptides of eukaryotic origin containing disulphide bonds. Deactivating mutations of one or more genes encoding a protein that tethers the outer membrane to the peptidoglycan skeleton, e.g., lpp, ompC, ompA, ompF, tolA, tolB, pal, and/or one or more genes encoding a periplasmic protease, e.g., degS, degP, nlpI, generates a leaky phenotype. Combinations of mutations may synergistically enhance the leaky phenotype.
Figure 55:
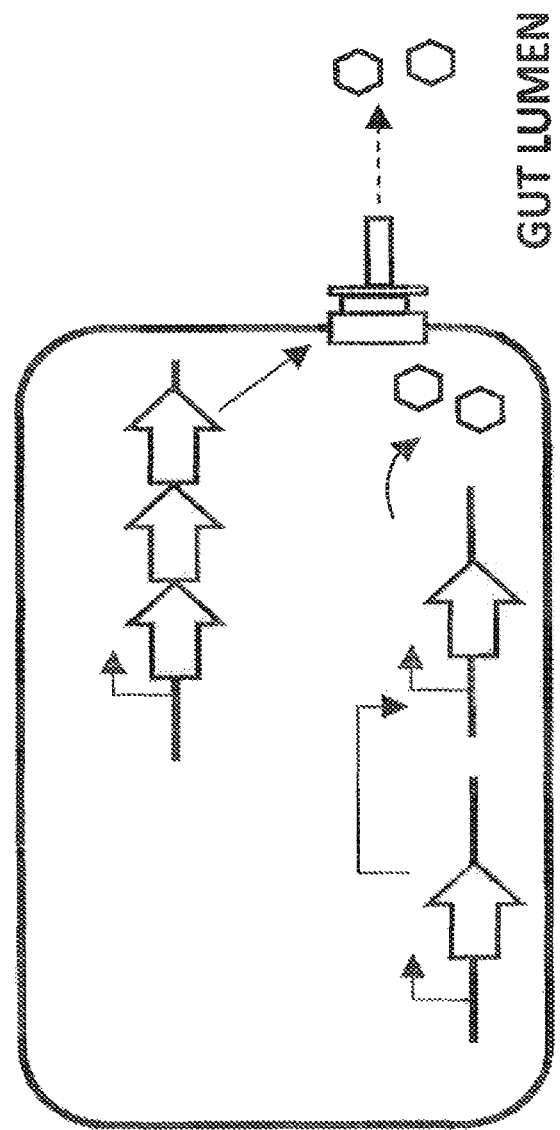
FIG. 55 depicts a modified type 3 secretion system (T3SS) to allow the bacteria to inject secreted therapeutic proteins into the gut lumen. An inducible promoter (small arrow, top), e.g. a FNR-inducible promoter, drives expression of the T3 secretion system gene cassette (3 large arrows, top) that produces the apparatus that secretes tagged peptides out of the cell. An inducible promoter (small arrow, bottom), e.g. a FNR-inducible promoter, drives expression of a regulatory factor, e.g. T7 polymerase, that then activates the expression of the tagged therapeutic peptide (hexagons).

Example 28. GLP-1 Production from Genetically Engineered Bacteria and Activity Measurements To determine whether GLP-1 can be expressed by the genetically engineered bacteria, a construct expressing GLP-1 in conjunction with a modified flagellar type III secretion system shown in FIG. 51 was generated and integrated into the *E. coli* Nissle chromosome. The construct comprises GLP-1 under control of the native FliC promoter and 5'UTR (untranslated region containing the N-terminal flagellar secretion signal) with an optimized ribosome binding site FIG. 21 and Table 50).

TABLE 50

GLP-1 construct sequences

| Description and SEQ ID NO | Sequence |
|---|---|
| GLP-1 under control of the native FliC promoter and 5'UTR with an optimized ribosome binding site (in reverse orientation) (SEQ ID NO: 223) | ttaaccacgacctttaaccagccaagcaataaactctttcgca gcctggccctccaaatagctagaaacatcagaagtgaaagtt ccctccgcgtggcgttcgaactcgtccatattacctcctgactgt gtctacttcgttgattacgttttgggtttccacccgtcggctcaatc gccgtca |
| GLP-1 (in reverse orientation) (SEQ ID NO: 224) | ttaaccacgacctttaaccagccaagcaataaactctttcgca gcctggccctccaaatagctagaaacatcagaagtgaaagtt ccctccgcgtggcgttcgaactcgtccat |
| FliC 5' UTR (in reverse orientation) (SEQ ID NO: 225) | attacctcctgactgtgtctacttcgttgattacgttttgggtttcca cccgtcggctcaatcgccgtca |
| Optimized RBS (in reverse orientation) (SEQ ID NO: 226) | attacctcctgactgtgtctacttc |
| Putative terminator (SEQ ID NO: 227) | gggcagaaaaaacccgccgttggcggggaagcacgttgc |
| GLP-1 construct comprising terminator (lower case italic) GLP-1 (lower case bold) under control of the native FliC promoter and 5'UTR (upper case bold, with optimized RBS underlined) and a chloramphenicol resistance gene under the control of the cat promoter (upper case italic bold), frt homology (upper case underlined) (SEQ ID NO: 228) | *Gggcagaaaaaacccgccgttggcggggaagcacgttg* ctggcaaattaccattcatgttgccggatgcggcgtaaacgcc ttatccggcctacaaaaatgtgcaaattcaataaattgcaattc cccttgtaggcctgataagcgcagcgcatcaggcaatttggc gttgccgtcagtctcagttaatcaggttacggcgattaaccac gacctttaaccagccaagcaataaactctttcgcagcctg gccctccaaatagctagaaacatcagaagtgaaagttcc ctccgcgtggcgttcgaactcgtccat<u>ATTACCTCCT GACTGTGTCTACTTCGTTGATTACGTTTTG GGTTTCCACCCGTCGGCTCAATCGCCGTC AACCCTGTTATCGTCTGTCGTAAAACAACC TTTAGAATTTTTTTCACAAACAGCCATTTTT TGTTAGTCGACGAAATACTCTTTTCTCTGC CCCTTATTCCCGCTATTAAAAAAAACAATT AAACGTAAACTTTGCGCAATTCAGGCCGA TAACCCCGGTATTCGTTTTACGTGTCGAAA GATAAACGAAGTTCCTATACTTTCTAGAGA ATAGGAACTTCGGAATAGGAACTTCATTTC</u> TCGTTCGCTGCCACCTAAGAATACTCTAC GGTCACATACAAATGGCGCGCCTTACGCC CCGCCCTGCCA*CTCATCGCAGTACTGTTG TATTCATTAAGCATCTGCCGACATGGAAG CCATCACAAACGGCATGATGAACCTGAA TCGCCAGCGGCATCAGCACCTTGTCGCC TTGCGTATAATATTTGCCCATGGTGAAAA CGGGGGCGAAGAAGTTGTCCATATTGGC CACGTTTAAATCAAAACTGGTGAAACTCA CCCAGGGATTGGCTGAGACGAAAAACAT ATTCTCAATAAACCCTTTAGGGAAATAGG CCAGGTTTTCACCGTAACACGCCACATCT TGCGAATATATGTGTAGAAACTGCCGGAA ATCGTCGTGGTATTCACTCCAGAGCGATG AAAACGTTTCAGTTTGCTCATGGAAAACG GTGTAACAAGGGTGAACACTATCCCATAT CACCAGCTCACCGTCTTTCATTGCCATAC GTAATTCCGGATGAGCATTCATCAGGCG GGCAAGAATGTGAATAAAGGCCGGATAA AACTTGTGCTTATTTTTCTTTACGGTCTTT AAAAAGGCCGTAATATCCAGCTGAACGG TCTGGTTATAGGTACATTGAGCAACTGAC TGAAATGCCTCAAAATGTTCTTTACGATG* |

TABLE 50-continued

GLP-1 construct sequences

| Description and SEQ ID NO | Sequence |
|---|---|
| | CCATTGGGATATATCAACGGTGGTATATC<br>CAGTGATTTTTTTCTCCATTTTAGCTTCCT<br>TAGCTCCTGAAAATCTCGACAACTCAAAA<br>AATACGCCCGGTAGTGATCTTATTTCATT<br>ATGGTGAAAGTTGGAACCTCTTACGTGCC<br>GATCAAACGTCTCATTTTCGCCAAAAGTTG<br>GCCCAGGGCTTCCCGGTATCAACAGGGA<br>CACCAGGATTTATTTATTCTGCGAAGTGAT<br>CTTCCGTCACAGGTAGGCGCGC<u>CGAAGTT<br>CCTATACTTTCTAGAGAATAGGAACTTCGG<br>AATAGGAACT</u> |

Cultures (the genetically engineered bacteria comprising the GLP-1 construct or streptomycin resistant control Nissle) are grown overnight in F-12K medium (Mediatech, Manassas, Va.) without glucose (containing selective antibiotics (chloramphenicol or streptomycin) and then diluted 1:200. The cells are grown with shaking at 250 rpm, and at indicated times (0, 3, 6, and 12 h), the supernatant aliquots are collected for GLP-1 quantification.

Additionally, bacteria are pelleted, washed, and harvested, resuspended in 25 mL sonication buffer (50 mM Tris-HCl, 30 mM NaCl, pH 8.0) with protease inhibitors, and lysed by sonication on ice. Unsoluble debris is spun down twice for 20 min at 12,000 rpm at 4° C. to detect any intracellular recombinant protein.

To generate cell free medium, the supernatant is centrifuged, and filtered through a 0.2 microm filter to remove any remaining bacteria. The cell-free culture medium (CFM) is diluted to OD600=1 with F-12K, and 10 ng/ml leupeptin, 200 μM PMSF and 5 ng/mL aproitinin was added to the CFM to inhibit proteases prior storage at 4° C.

Western Blotting

The cell-free culture medium (CFM) was diluted to the same OD600 with F-12K, and 10 ng/ml leupeptin, PMSF and 5 ng/mL aproitinin was added to inhibit proteases. Clarified supernant (14 ml) is precipitated with 10% trichloroacetic acid (TCA, VWR) for 30 min on ice, and the pellet was washed twice in ice-cold ethanol/ether (1:1). The supernatant pellet is dried under vacuum, dissolved in 50 μl sample buffer (2% SDS, 50 mM Tris, pH 6.8, 20% glycerol, 10% mercaptoethanol, bromophenol blue) and boiled for 5 min at 95° C. The cell pellet is resuspended (From 14 ml culture) in room temperature BugBuster Master Mix by gentle vortexing, using 500 μl BugBuster Master Mix with protease inhibitors (10 ng/ml Leupeptin, 200 μMPMSF and 5 ng/mL aproitinin). The cell suspension is incubated on a shaking platform (VWR, Bristol, Conn.) at a slow setting for 10-20 min at room temperature. 125 μl 5× sample buffer is added to each sample before and boiling for 10 min at 95° C.

Protein concentration is determined by BCA protein assay, and isolated proteins are analyzed by Western blot. Proteins are transferred onto PVDF membranes are detected with an HRP-conjugated Glucagon Antibody (24HCLC), ABfinity™ Rabbit Oligoclonal, Thermo Fisher.

Co-Culture with Caco-2 Cells and ELISA for Insulin

To determine whether the GLP-1 expressed by the genetically engineered bacteria is functional, a co-culture experiment is conducted in which the bacterial supernatant containing GLP-1 is added to the growth medium of a mammalian intestinal cell line, Caco-2. Caco-2 cells are an intestinal cell line derived from a human colorectal carcinoma that spontaneously differentiates under standard culture conditions, and which lends itself to the in vitro study of human gut. The ability of the Caco-2 cells to produce insulin upon exposure to the bacterial cell free supernatant is measured.

Caco-2 epithelial cells (ATCC# CRL-2102, Manassas, Va.) are maintained in Dulbecco's Modified Eagle Media (DMEM, Cellgro, Herndon, Va.) plus 10% FBS (Cellgro) at 37° C. in a humidified incubator supplemented with 5% CO2. For co-culture experiments, Caco-2 cells are grown in F-12K supplemented with 10% FBS at 37° C. in a humidified incubator supplemented with 5% CO2. All co-culture experiments are performed in F-12K plus 10% FBS with Caco-2 cells in passages between 15 and 22.

Approximately 80% confluent monolayers of Caco-2 cells in 12-well plates are washed with fresh F-12K plus 10% FBS once and covered with 1 mL 50% CFM in F-12K with 10% FBS and incubated at 37° C. with 5% $CO_2$. 200 nM. As a control, the same volume of recombinant GLP-1 (200 nM) in F-12K with 10% FBS is added as a positive control in separate wells. Following a 16 h incubation, an additional 1 mL of 50% CFM in F-12K with 10% FBS or GLP-1 is added to the cells, supplemented with 0.4% Glucose or 0.4% Glycerol before incubation for an additional 2 h. The media is removed from the cells, supplemented with Leupeptin (10 ng/mL), 0.2 mM PMSF and aprotinin (10 ng/mL), centrifuged (12,000×rpm), and kept briefly at 4° C. prior to ELISA analysis for insulin expression (see "Immuno-blot and ELISA" section).

In order to estimate the amount of insulin secreted from Caco-2 cells activated by Glp-1, cell free supernatants are assayed using standard ELISA procedures using the Insulin ELISA Kit, Human (KAQ125, Thermo Fisher), according to manufacturer's instructions.

Example 30. In Vivo NASH Studies

For in vivo studies, a mouse model is used to study the effects of liver steatosis and hepatic inflammation (Jun Jin, et al., Brit. J. Nutrition, 114:145-1755 (2015)). To briefly summarize, female C57BL/6J mice are fasted and fed either a standard liquid diet of carbohydrates, fat, and protein; or a liquid Western style diet (WSD) fortified with fructose, fat, cholesterol, and a sodium butyrate supplement for six weeks. Butyrate is a short chain fatty acid naturally produced by intestinal bacteria effective in maintaining intestinal homoeostasis. Body weight and plasma samples can be taken throughout the duration of the study. Upon conclusion of the study, the mice can be killed, and the liver and intestine can be removed and assayed. A decrease in liver damage after treatment with the engineered bacterial cells indicates that the engineered bacterial cells described herein are effective for treating nonalcoholic steatohepatitis (NASH).

Additionally, throughout the study, phenotypes of the mice can also be analyzed. A decrease in the number of symptoms associated with nonalcoholic steatohepatitis (NASH), for example, weight loss, further indicates the efficacy of the engineered bacterial cells described herein for treating nonalcoholic steatohepatitis (NASH).

Example 31. Construction of Plasmids Encoding Bile Salt Hydrolase Enzymes

The bile salt hydrolase genes from *Lactobacillus plantarum* (SEQ ID NO:1) is synthesized (Genewiz), fused to the Tet promoter, cloned into the high-copy plasmid pUC57-Kan by Gibson assembly, and transformed into *E. coli* DH5α as described herein to generate the plasmid pTet-BSH.

Example 32. Generation of Recombinant Bacteria Comprising a Bile Salt Hydrolase Enzyme The pTet-BSH plasmid described above is transformed into *E. coli* Nissle, DH5α, or PIR1. All tubes, solutions, and cuvettes are pre-chilled to 4° C. An overnight culture of *E. coli* (Nissle, DH5α or PIR1) is diluted 1:100 in 4 mL of LB and grown until it reaches an $OD_{600}$ of 0.4-0.6. 1 mL of the culture is then centrifuged at 13,000 rpm for 1 min in a 1.5 mL microcentrifuge tube and the supernatant is removed. The cells are then washed three times in pre-chilled 10% glycerol and resuspended in 40 uL pre-chilled 10% glycerol. The electroporator is set to 1.8 kV. 1 uL of a pTet-BSH miniprep is added to the cells, mixed by pipetting, and pipetted into a sterile, chilled 1 mm cuvette. The dry cuvette is placed into the sample chamber, and the electric pulse is applied. 500 uL of room-temperature SOC media is immediately added, and the mixture is transferred to a culture tube and incubated at 37° C. for 1 hr. The cells are spread out on an LB plate containing 50 ug/mL Kanamycin for pTet-BSH.

Example 33. Functional Assay Demonstrating that the Recombinant Bacterial Cells Decrease Bile Salt Concentration For in vitro studies, all incubations will be performed at 37° C. Cultures of *E. coli* Nissle containing pTet-BSH are grown overnight in LB and then diluted 1:100 in LB. The cells are grown with shaking (250 rpm) to early log phase with the appropriate antibiotics. Anhydrous tetracycline (ATC) is added to cultures at a concentration of 100 ng/mL to induce expression of bile salt hydrolase, and bacteria are grown for another 3 hours. Culture broths are then inoculated at 20% in flasks containing fresh LB culture media containing excess bile salts (either 0.5% (wt/vol) TDCA, 0.5% (wt/vol) GDCA, or 3% (vol/vol) human bile) and grown for 16 hours with shaking (250 rpm). A "medium blank" for each culture condition broth is also prepared whereby the "medium blank" is not inoculated with bacteria but treated under the same conditions as the inoculated broths. Following the 16 hour incubation period, broth cultures are pasteurized at 90° C. for 15 minutes, centrifuged at 5,000 rpm for 10 minutes, and supernatants filtered with a 0.45 micron filter.

Bile salt levels and activity in the supernatants is determined. Briefly, bile salt hydrolase activity can be assessed using a plate assay as described in Dashkevicz and Feighner, *Applied Environ. Microbiol.*, 55:11-16 (1989) and Christiaens et al., *Appl. Environ. Microbiol.*, 58:3792-3798 (1992). BSH activity can also be indicated by halos of precipitated deconjugated bile acids (see, also, Jones et al., *PNAS*, 105(36):13580-13585 (2008)). A ninhydrine assay for free taurine has also been described (see, for example, Clarke et al., *Gut Microbes*, 3(3):186-202 (2012)).

Example 34. In Vivo Studies Demonstrating that the Recombinant Bacterial Cells Decrease Bile Salt Concentration For in vivo studies, a mouse model of weight gain and lipid metabolism (as described by Joyce et al., *PNAS*, 111(20):7421-7426 (2014)) is used. To briefly summarize, C57BL/6J mice and germ-free Swiss Webster mice can be fasted and fed either a normal low-fat diet or a high-fat diet for ten weeks. After ten weeks, the mice can be inoculated with recombinant bacteria comprising a bile salt hydrolase enzyme (as described herein) or control bacteria. Body weight, plasma samples, and fecal samples can be taken throughout the duration of the study. Upon conclusion of the study, the mice can be killed, and internal organs (liver, spleen, intestines) and fat pads can be removed and assayed. Treatment efficacy is determined, for example, by measuring levels of bile salts and bile acids. A decrease in levels of bile salts after treatment with the recombinant bacterial cells indicates that the recombinant bacterial cells described herein are effective for treating disorders associated with bile salts.

Additionally, throughout the study, phenotypes of the mice can also be analyzed. A decrease in the number of symptoms associated with disorders associated with bile salts, for example, weight loss, further indicates the efficacy of the recombinant bacterial cells described herein for treating disorders associated with bile salts.

Example 35. Generation of *E. coli* Mutants with Ability to Consume L-Kynurenine and Produce Tryptophan from Kyrurenine

*E. coli* Nissle can be engineered to efficiently import KYN and convert it to TRP. A strain was constructed (tryptophan auxotroph) that also expresses exogenous *Pseudomonas fluorescens* kynureninase mutation, with the goal of generating a strain that is capable of converting L-kynurenine to anthranilate. Anthranilate can then be converted tryptophan through the enzymes of the tryptophan biosynthetic pathway.

*E. coli* naturally utilizes anthranilate in its TRP biosynthetic pathway. Briefly, the TrpE (in complex with TrpD) enzyme converts chorismate into anthranilate. TrpD, TrpC, TrpA and TrpB then catalyze a five-step reaction ending with the condensation of an indole with serine to form tryptophan. Next, the kynureninase si introduced into a strain which harbors ΔtrpE (trypophan auxotrophy) deletion. By deleting the TrpE enzyme via lambda-RED recombineering, the subsequent strain of Nissle (ΔtrpE::Cm) is an auxotroph unable to grow in minimal media without supplementation of TRP or anthranilate. By expressing kynureninase in ΔtrpE::Cm (KYNase-trpE), this auxotrophy should alternatively rescued by providing KYN.

Indeed, as a proof of concept, we were able to show that while Nissle does not typically utilize KYN—by introducing the Kynureninase (KYNase) from *Pseudomonas fluorescens* (kynU) on a medium-copy plasmid under the control of the tetracycline promoter (Ptet) a new strain with this plasmid (Ptet-KYNase) was able to convert L-kynurenine into anthranilate in the presence of a Tet inducer.

TABLE 51

| STRAIN | Rich Media | Min Media | Min + Anthranilate | Min + KYNU + aTc |
|---|---|---|---|---|
| Wild type Nissle | + | + | + | + |
| tipE | + | − | + | − |
| tipE pseudoKYNase | + | − | + | + |
| tipE hKYNase | + | − | + | − |

In a preliminary assay (Table 51), wildtype Nissle (SYN094), Nissle with a deletion of trpE, and trpE mutants expressing either the human kynureninase (hKYNase) or the *Pseudomonas fluorescens* kynureninase (pseudoKYNase) from a Ptet promoter on a medium-copy plasmid were grown in either rich media, minimal media (min media), minimal media with 5 mM anthranilate (Min+anthranilate) or minimal media with 10 mM kynurenine and 100 ng/uL aTc (Min+KYNU+aTc). These were grown in 1 mL of media in a deep well plate with shaking at 37° C. A positive for growth (+) in Table 51 indicates a change in optical density of >5-fold from inoculation.

The results show that in a mutant trpE (which is typically used in the tryptophan biosynthetic pathway to convert chorismate into anthranilate) background, Nissle is unable to grow in minimal media without supplementation with anthranilate (or tryptophan). When minimal media was supplemented with KYNU, the trpE mutant was also unable to grow. However, when the pseudoKYNase was expressed in the trpE tryptophan-auxotroph the cells were able to grow in Min+KYNU. This indicates that Nissle is able to import L-kynurenine from the media and convert it into anthranilate using the pseudoKYNase. The hKYNase homolog was unable to support growth on M9+KYNU, most likely due to differences in substrate specificity as it has been documented that the human kynureninase prefers 3-hydroxykynurenine as a substrate (Phillips, Structure and mechanism of kynureninase. Arch Biochem Biophys. 2014 Feb. 15; 544: 69-74).

Example 36. Generation of *E. coli* Mutants with Enhanced Ability to Consume L-Kynurenine and Produce Tryptophan from Kyrurenine Adaptive Laboratory Evolution was used to produce mutant bacterial strains with improved Kynurenine consumption and reduced tryptophan uptake. First a lower limit of KYN concentration was established and mutants were evolved by passaging in lowering concentrations of KYN.

While this can select for mutants capable of increasing KYN import, the bacterial cells still prefer to utilize free, exogenous TRP. In the tumor environment, dual-therapeutic functions can be provided by depletion of KYN and increasing local concentrations of TRP. Therefore, to evolve a strain which prefers KYN over TRP, a toxic analogue of TRP—5-fluoro-L-tryptophan (ToxTRP)—can be incorporated into the ALE experiment. The resulting best performing strain is then whole genome sequenced in order to deconvolute the contributing mutations. Lambda-RED can be performed in order to reintroduce TrpE, to inactivate Trp regulation (trpR, tyrR, transcriptional attenuators) to up-regulate TrpABCDE expression and increase chorismate production. The resulting strain prefers external KYN over to external TRP, efficiently converts KYN into TRP, and also now overproduces TRP.

Moving forward with the knowledge that Nissle is able to grow on KYNU supplemented minimal media in a trpE auxotroph by importing and converting kynurenine, the next step was to establish the minimal concentrations of kynurenine capable of supporting growth. Additionally, in our selection experiment if 5-fluoro-L-tryptophan (ToxTrp) was employed the concentrations of both KYNU and ToxTrp capable of still sustaining growth.

A growth assay was performed in 96-well plates using streptomycin resistant Nissle, trpE and trpE pseudoKYNase with and without induction of pseudoKYNase expression using 100 ng/uL aTc. These strains were inoculated at very dilute concentrations into M9 minimal media with varying concentrations of KYNU across columns (2-fold dilutions starting at 2000 ug/mL) and varying concentrations of ToxTrp across rows (2-fold dilutions starting at 200 ug/mL). On a separate plate, the strains were grown in M9+KYNU (at the same concentrations) in the absence of ToxTrp, as described in Example 15.

The results of the initial checkerboard assay are displayed in FIG. 7-9 as a function of optical density at 600 nm (normalized to a media blank). In FIGS. 7 and 8, the X-axis shows decreasing KYNU concentration from left-to-right, while the Z-axis shows decreasing ToxTrp concentration from front-to-back with the very back row representing media with no ToxTrp. In FIG. 9. the control sand trpE strains are shown in M9+KYNU without any ToxTrp, as there was no growth detected from either strain at any concentration of ToxTrp. The results of the assay show that expression of the pseudoKYNase provides protection against toxicity of ToxTrp. More importantly, growth is permitted between 250-62.5 ug/mL of KYNU and 6.3-1.55 ug/mL of ToxTrp.

Together these experiments establish that expression of the *Pseudomonas fluorescens* kynureninase is sufficient to rescue a trpE auxotrophy in the presence of kynurenine, as the strain ia able to consume KYN into anthranilate, and upstream metabolite in the TRP biosynthetic pathway. In addition, the KYNase is also capable of providing increased resistance to the toxic tryptophan, 5-fluoro-L-tryptophan. Using the information attained here it is possible to proceed to an adaptive laboratory evolution experiment to select for mutants with highly efficient and selective conversion of kynurenine to tryptophan.

Example 37. Checkerboard Assay and ALE Parameters

To establish the minimum concentration of L-kynurenine and maximum concentration of 5-fluoro-L-tryptophan (ToxTrp) capable of sustaining growth of the KYNase strain, using a checkerboard assay, the following protocol was used. Using a 96-well plate with M9 minimal media with glucose, KYN is supplemented decreasing across columns in 2-fold dilutions from 2000 ug/mL down to ~1 ug/mL. In the rows, ToxTrp concentration decreases by 2-fold from 200 ug/mL down to ~1.5 ug/mL. In one plate, Anhydrous Tetracycline (aTc) was added to a final concentration of 100 ng/uL to induce production of the KYNase. From an overnight culture cells were diluted to an OD600=0.5 in 12 mL of TB (plus appropriate antibiotics and inducers, where applicable) and grown for 4 hours. 100 uL of cells were spun down and resuspended to an OD600=1.0. These were diluted 2000-fold and 25 uL was added to each well to bring the final volumes in each well to 100 uL. Cells were grown for roughly 20 hours with static incubation at 37 C then growth was assessed by OD600, making sure readings fell within linear range (0.05-1.0).

Once identified, the highest concentrations of ToxTrp and lowest concentration of kynurenine capable of supporting growth becomes the starting point for ALE. The ALE parental strain was chosen by culturing the KYNase strain on M9 minimal media supplemented with glucose and L-kynurenine (referred to as M9+KYNU from here on). A single colony was selected, resuspended in 20 uL of sterile phosphate-buffered saline solution. This colony was then used to inoculate three cultures of M9+KYNU, grown into late-logarithmic phase and optical density determined at 600 nm. These cultures were then diluted to $10^3$ in 4 rows of a 96-well deep-well plate with 1 mL of M9+KYNU. Each one of the four rows has a different ToxTrp (increasing 2-fold), while each column has decreasing concentrations of KYNU (by 2-fold). Each morning and evening this plate is diluted back to 103 using the well in which the culture has grown to just below saturation so that the culture is always in logarithmic growth. This process is repeated until a change in growth rate is no longer detected. Once no growth rate increases are detected (usually around $10^{11}$ Cumulative Cell Divisions) the culture is plated onto M9+KYNU (Lee, et al., Cumulative Number of Cell Divisions as a Meaningful Timescale for Adaptive Laboratory Evolution of *Escherichia coli*. PLoS ONE 6, e26172; 2011). Individual colonies are selected and screened in M9+KYNU+ToxTrp media to confirm increased growth rate phenotype. Once mutants with significantly increased growth rate on M9+KYNU are isolated, genomic DNA can be isolated and sent for whole genome sequencing to reveal the mutations responsible for phenotype. All culturing is done shaking at 350 RPM at 37° C.

Example 38. Nitric Oxide-Inducible Reporter Constructs

Figure 28:
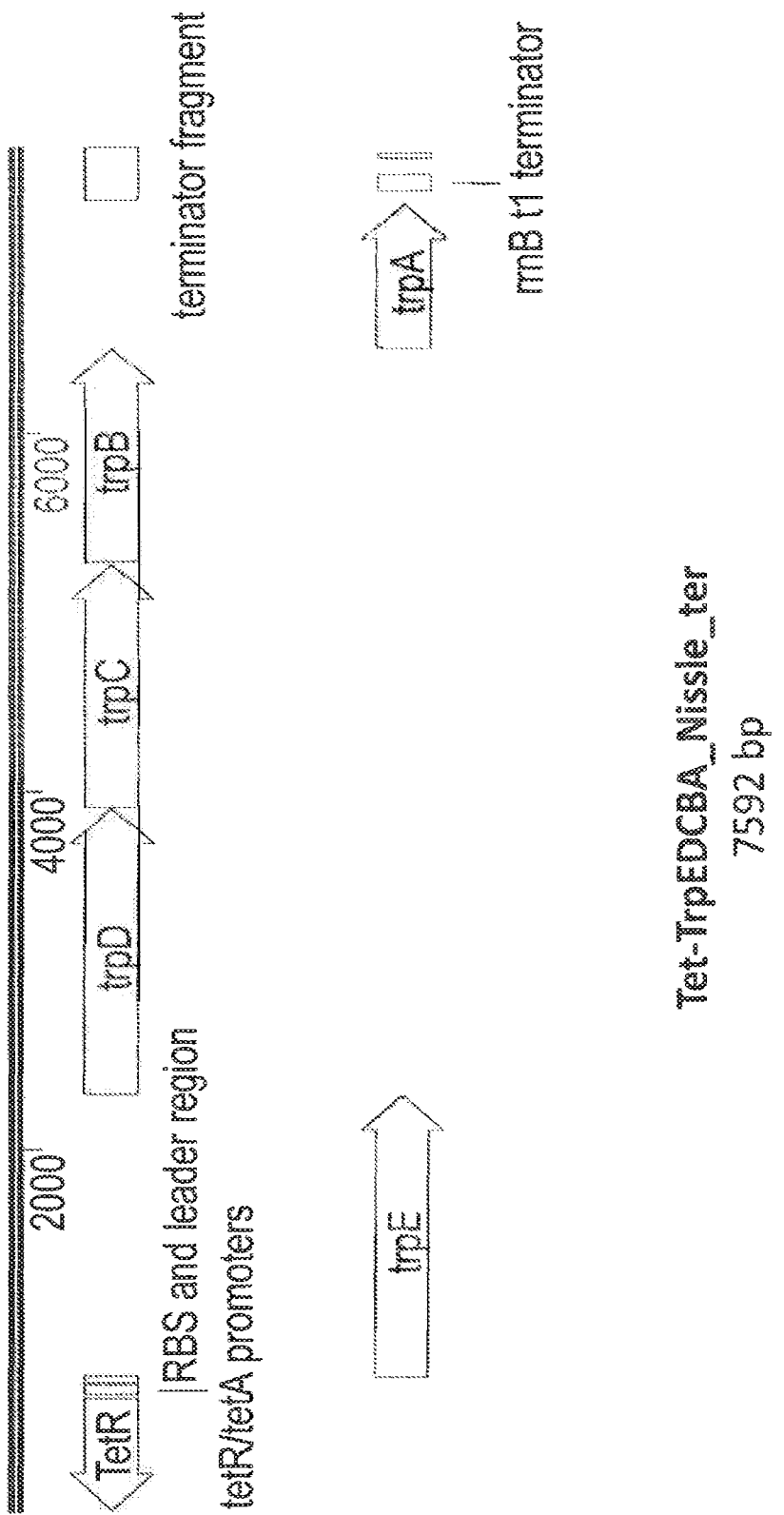
FIG. 28 depicts one embodiment of the disclosure in which the *E. coli* TRP synthesis enzymes are expressed from a construct under the control of a tetracycline inducible system.

ATC and nitric oxide-inducible reporter constructs were synthesized (Genewiz, Cambridge, Mass.). When induced by their cognate inducers, these constructs express GFP, which is detected by monitoring fluorescence in a plate reader at an excitation/emission of 395/509 nm, respectively. Nissle cells harboring plasmids with either the control, ATC-inducible Ptet-GFP reporter construct, or the nitric oxide inducible PnsrR-GFP reporter construct were first grown to early log phase (OD600 of about 0.4-0.6), at which point they were transferred to 96-well microtiter plates containing LB and two-fold decreased inducer (ATC or the long half-life NO donor, DETA-NO (Sigma)). Both ATC and NO were able to induce the expression of GFP in their respective constructs across a range of concentrations (FIG. 28); promoter activity is expressed as relative florescence units. An exemplary sequence of a nitric oxide-inducible reporter construct is shown. The bsrR sequence is bolded. The gfp sequence is underlined. The PnsrR (NO regulated promoter and RBS) is italicized. The constitutive promoter and RBS are boxed. These constructs, when induced by their cognate inducer, lead to high level expression of GFP, which is detected by monitoring fluorescence in a plate reader at an excitation/emission of 395/509 nm, respectively. Nissle cells harboring plasmids with either the ATC-inducible Ptet-GFP reporter construct or the nitric oxide inducible PnsrR-GFP reporter construct were first grown to early log phase (OD600=~0.4-0.6), at which point they were transferred to 96-well microtiter plates containing LB and 2-fold decreases in inducer (ATC or the long half-life NO donor, DETA-NO (Sigma)). It was observed that both the ATC and NO were able to induce the expression of GFP in their respective construct across a wide range of concentrations. Promoter activity is expressed as relative florescence units.

FIG. 64 shows NO-GFP constructs (the dot blot) *E. coli* Nissle harboring the nitric oxide inducible NsrR-GFP reporter fusion were grown overnight in LB supplemented with kanamycin. Bacteria were then diluted 1:100 into LB containing kanamycin and grown to an optical density of 0.4-0.5 and then pelleted by centrifugation. Bacteria were resuspended in phosphate buffered saline and 100 microliters were administered by oral gavage to mice. IBD is induced in mice by supplementing drinking water with 2-3% dextran sodium sulfate for 7 days prior to bacterial gavage. At 4 hours post-gavage, mice were sacrificed and bacteria were recovered from colonic samples. Colonic contents were boiled in SDS, and the soluble fractions were used to perform a dot blot for GFP detection (induction of NsrR-regulated promoters). Detection of GFP was performed by binding of anti-GFP antibody conjugated to HRP (horse radish peroxidase). Detection was visualized using Pierce chemiluminescent detection kit. It is shown in the figure that NsrR-regulated promoters are induced in DSS-treated mice, but are not shown to be induced in untreated mice. This is consistent with the role of NsrR in response to NO, and thus inflammation.

Bacteria harboring a plasmid expressing NsrR under control of a constitutive promoter and the reporter gene gfp (green fluorescent protein) under control of an NsrR-inducible promoter were grown overnight in LB supplemented with kanamycin. Bacteria are then diluted 1:100 into LB containing kanamycin and grown to an optical density of about 0.4-0.5 and then pelleted by centrifugation. Bacteria are resuspended in phosphate buffered saline and 100 microliters were administered by oral gavage to mice. IBD is induced in mice by supplementing drinking water with 2-3% dextran sodium sulfate for 7 days prior to bacterial gavage. At 4 hours post-gavage, mice were sacrificed and bacteria were recovered from colonic samples. Colonic contents were boiled in SDS, and the soluble fractions were used to perform a dot blot for GFP detection (induction of NsrR-regulated promoters) Detection of GFP was performed by binding of anti-GFP antibody conjugated to HRP (horse radish peroxidase). Detection was visualized using Pierce chemiluminescent detection kit. FIG. 65 shows NsrR-regulated promoters are induced in DSS-treated mice, but not in untreated mice.

Example 39. FNR Promoter Activity

Figure 62:
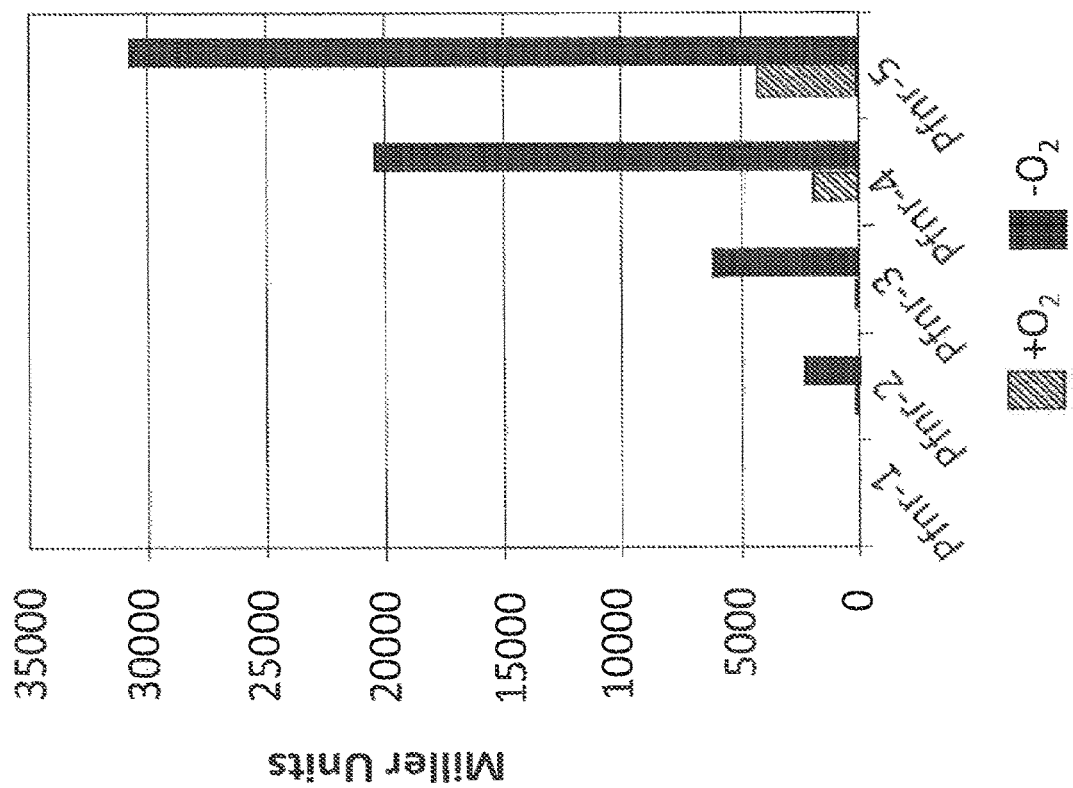
FIG. 62 depicts β-galactosidase levels in samples comprising bacteria harboring a low-copy plasmid expressing lacZ from an FNR-responsive promoter selected from the exemplary FNR promoters shown in Table 2 (Pfnr1-5). Different FNR-responsive promoters were used to create a library of anaerobic-inducible reporters with a variety of expression levels and dynamic ranges. These promoters included strong ribosome binding sites. Bacterial cultures were grown in either aerobic ($+O_2$) or anaerobic conditions ($-O_2$). Samples were removed at 4 hrs and the promoter activity based on β-galactosidase levels was analyzed by performing standard β-galactosidase colorimetric assays.
Figure 63A:
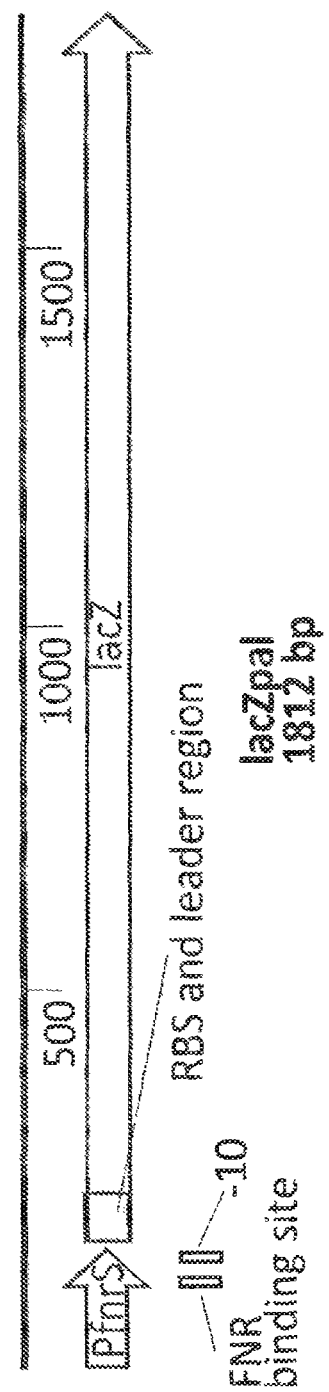
FIG. 63A depicts a schematic representation of the lacZ gene under the control of an exemplary FNR promoter ($P_{fnrS}$). LacZ encodes the β-galactosidase enzyme and is a common reporter gene in bacteria.
Figure 63B:
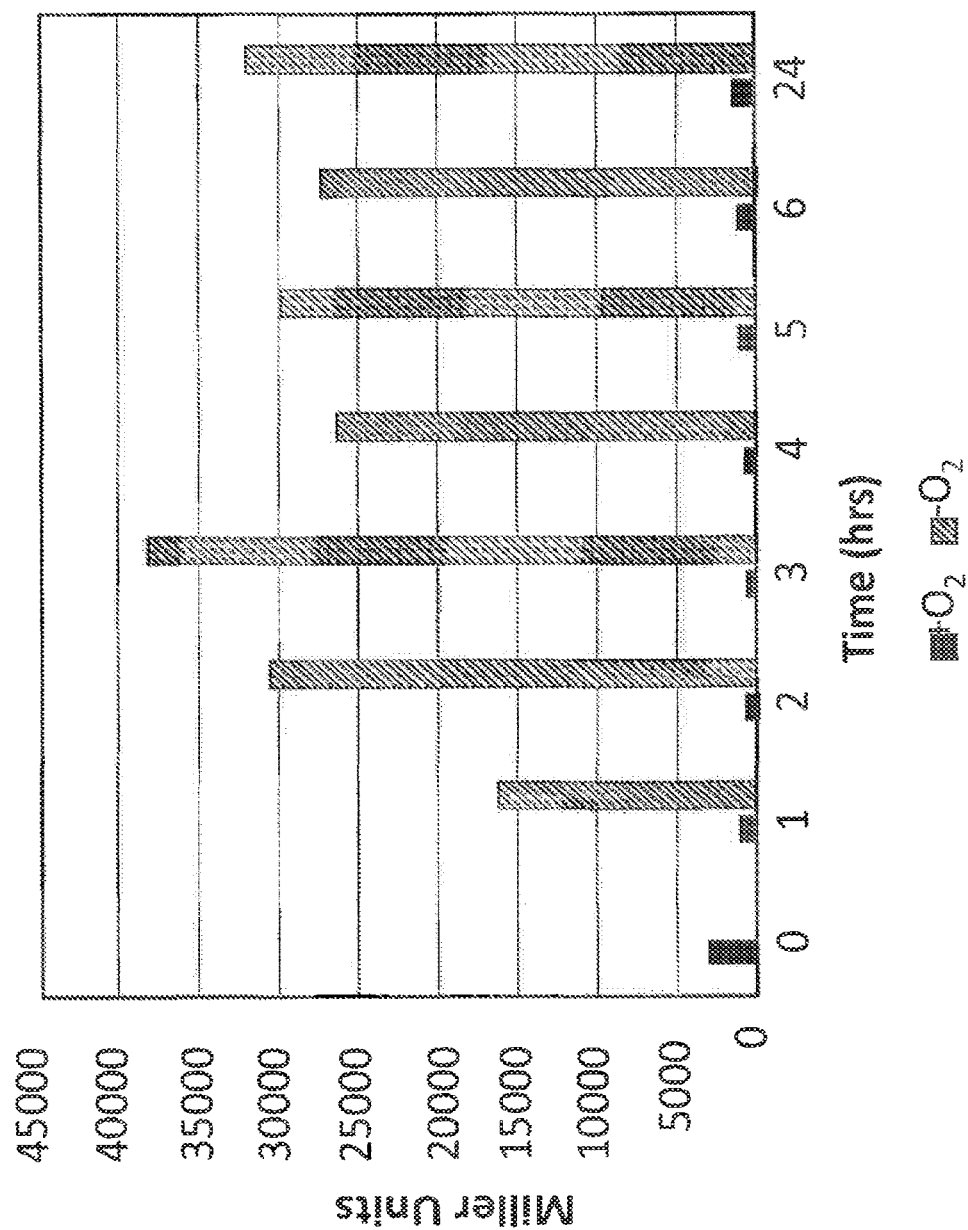
FIG. 63B depicts FNR promoter activity as a function of β-galactosidase activity in SYN340. SYN340, an engineered bacterial strain harboring a low-copy fnrS-lacZ fusion gene, was grown in the presence or absence of oxygen. Values for standard β-galactosidase colorimetric assays are expressed in Miller units (Miller, 1972). These data suggest that the fnrS promoter begins to drive high-level gene expression within 1 hr under anaerobic conditions.
Figure 63C:
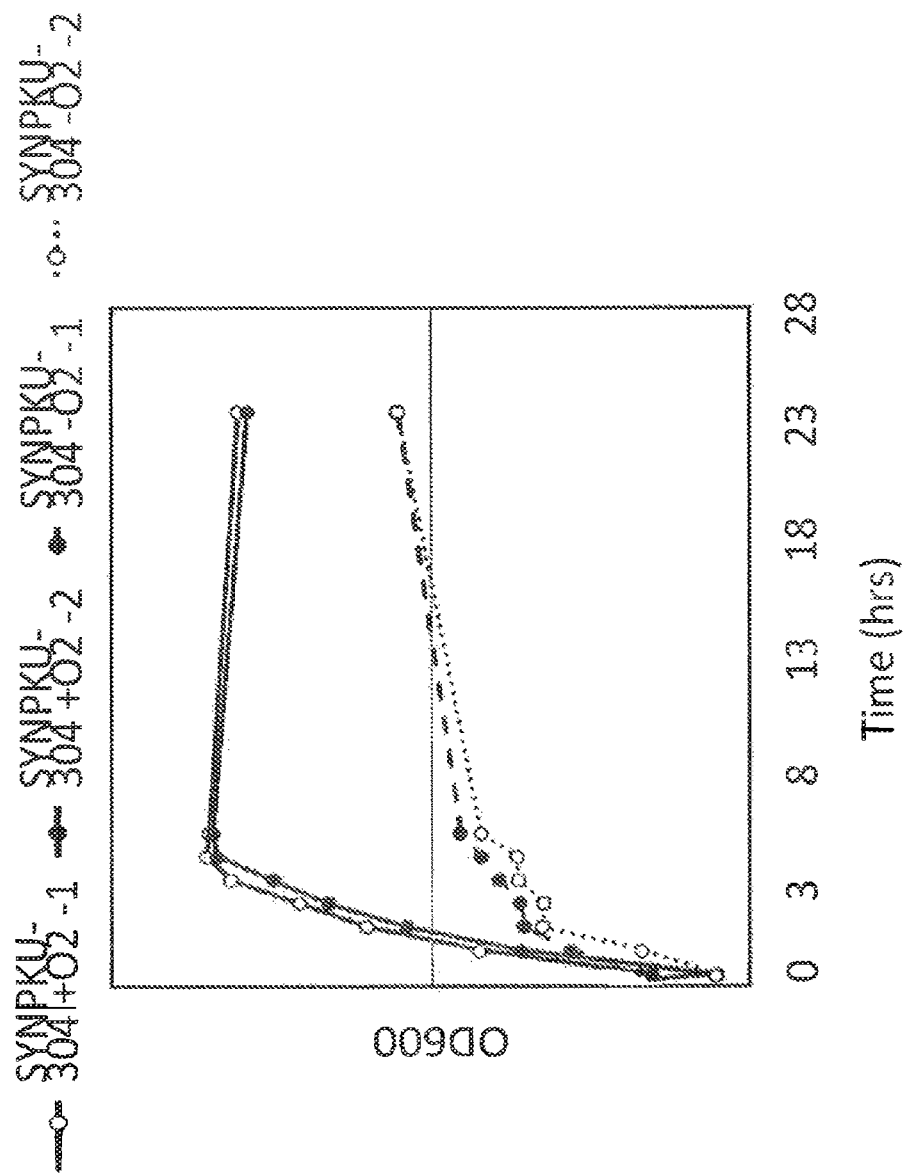
FIG. 63C depicts the growth of bacterial cell cultures expressing lacZ over time, both in the presence and absence of oxygen.
Figure 64A:
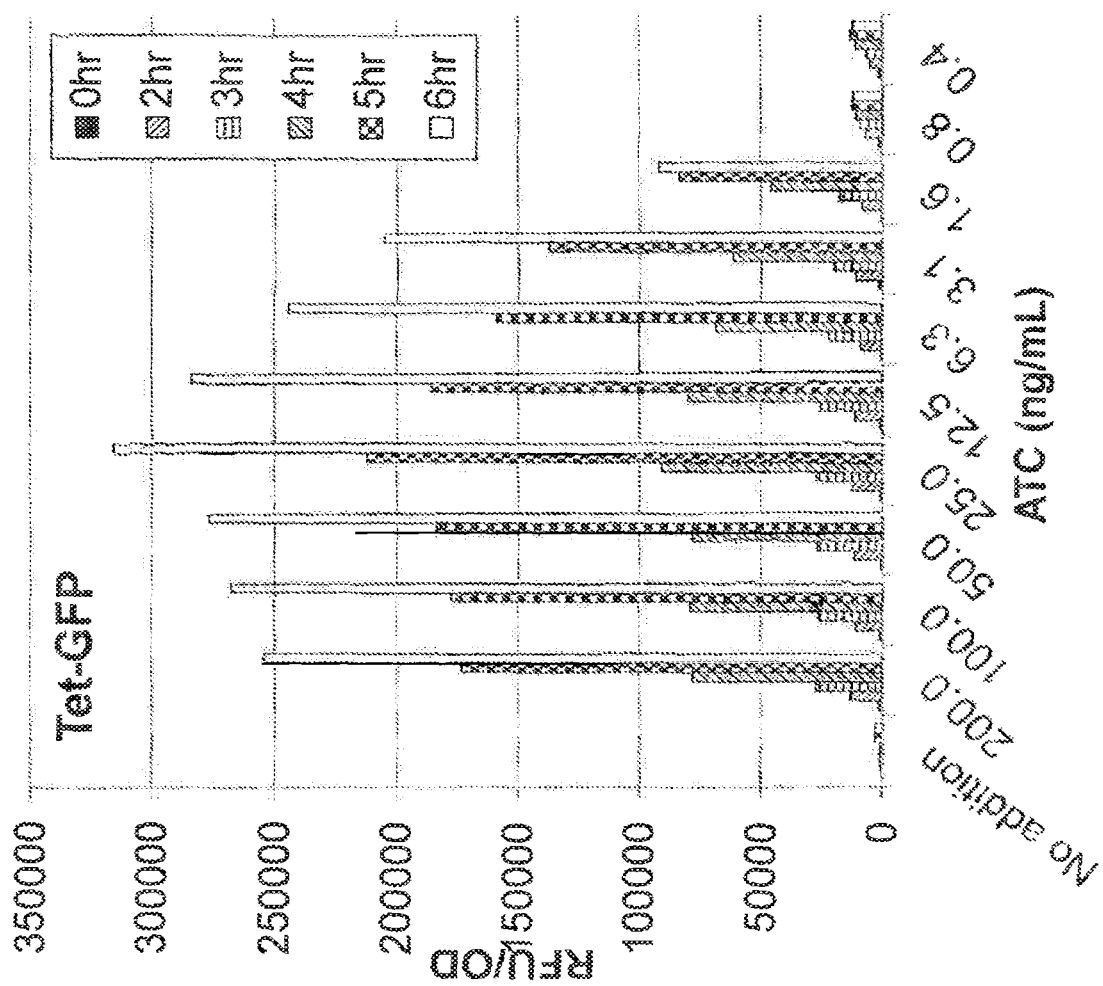
FIG. 64 depicts ATC (FIG. 64A) or nitric oxide-inducible (FIG. 64B) reporter constructs. These constructs, when induced by their cognate inducer, lead to expression of GFP. Nissle cells harboring plasmids with either the control, ATC-inducible $P_{tet}$-GFP reporter construct or the nitric oxide inducible $P_{nsrR}$-GFP reporter construct induced across a range of concentrations. Promoter activity is expressed as relative florescence units.
FIG. 64C depicts a schematic of the constructs.
FIG. 64D depicts a dot blot of bacteria harboring a plasmid expressing NsrR under control of a constitutive promoter and the reporter gene gfp (green fluorescent protein) under control of an NsrR-inducible promoter. DSS-treated mice serve as exemplary models for HE. As in HE subjects, the guts of mice are damaged by supplementing drinking water with 2-3% dextran sodium sulfate (DSS). Chemiluminescent is shown for NsrR-regulated promoters induced in DSS-treated mice.
Figure 64B:
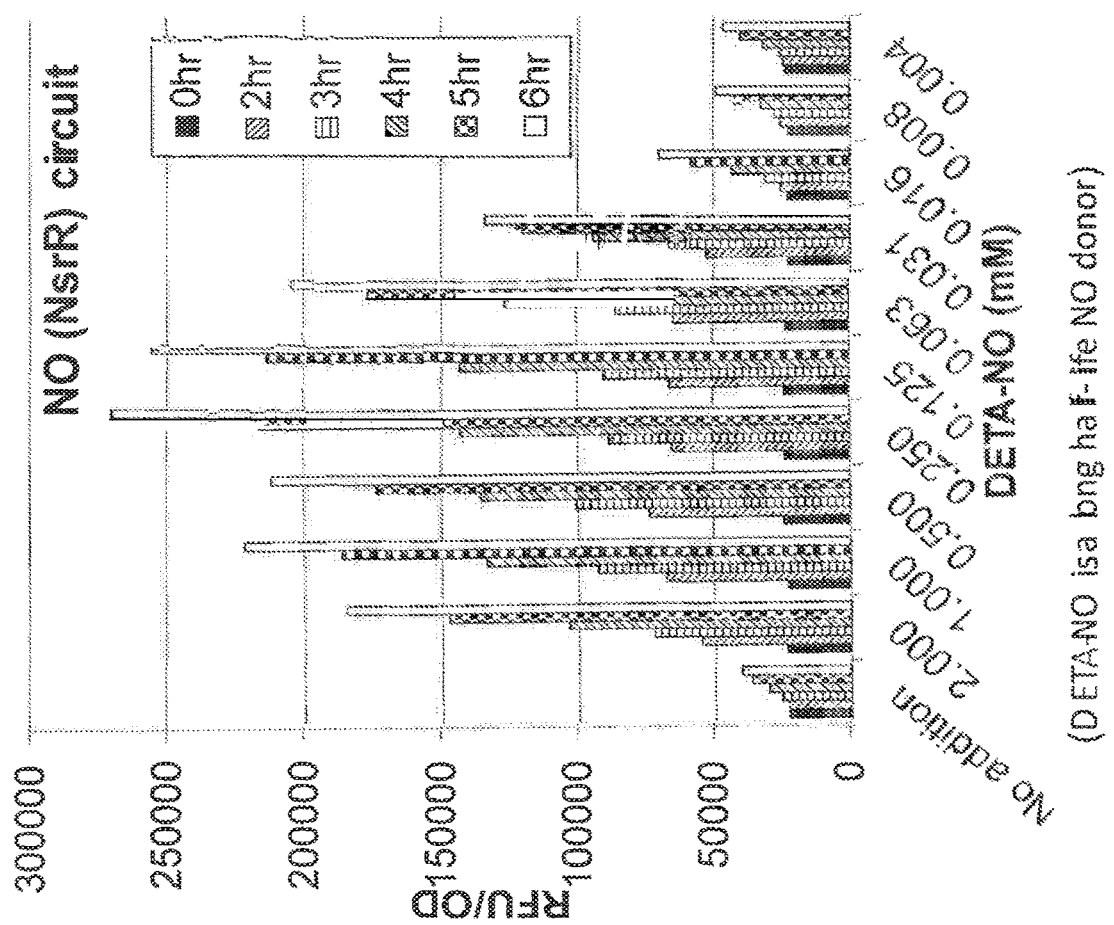
Figure 64C:
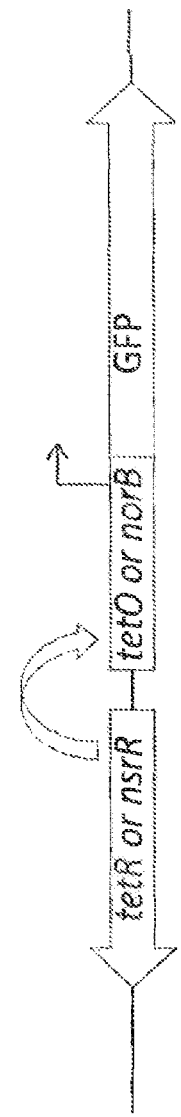
Figure 64D:
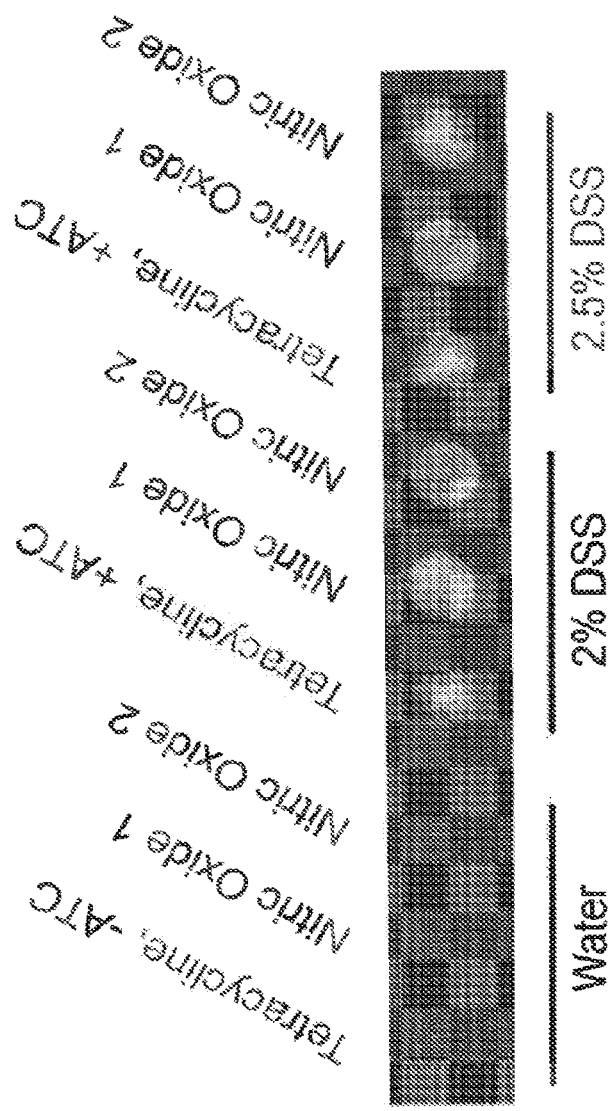

In order to measure the promoter activity of different FNR promoters, the lacZ gene, as well as transcriptional and translational elements, were synthesized (Gen9, Cambridge, Mass.) and cloned into vector pBR322. The lacZ gene was placed under the control of any of the exemplary FNR promoter sequences disclosed in Table 21. The nucleotide sequences of these constructs are shown in Tables 52-56 ((SEQ ID NO: 228-229). However, as noted above, the lacZ gene may be driven by other inducible promoters in order to analyze activities of those promoters, and other genes may be used in place of the lacZ gene as a readout for promoter activity, exemplary results are shown in FIG. 62.

Table 52 shows the nucleotide sequence of an exemplary construct comprising a gene encoding lacZ, and an exemplary FNR promoter, P$_{fnr1}$ (SEQ ID NO: 228). The construct comprises a translational fusion of the Nissle nirB1 gene and the lacZ gene, in which the translational fusions are fused in frame to the 8$^{th}$ codon of the lacZ coding region. The P$_{fnr1}$ sequence is bolded lower case, and the predicted ribosome binding site within the promoter is underlined. The lacZ sequence is underlined upper case. ATG site is bolded upper case, and the cloning sites used to synthesize the construct are shown in regular upper case.

Table 53 shows the nucleotide sequence of an exemplary construct comprising a gene encoding lacZ, and an exemplary FNR promoter, P$_{fnr2}$ ((SEQ ID NO: 229). The construct comprises a translational fusion of the Nissle ydJZ gene and the lacZ gene, in which the translational fusions are fused in frame to the 8$^{th}$ codon of the lacZ coding region. The P$_{fnr2}$ sequence is bolded lower case, and the predicted ribosome binding site within the promoter is underlined. The lacZ sequence is underlined upper case. ATG site is bolded upper case, and the cloning sites used to synthesize the construct are shown in regular upper case.

Table 54 shows the nucleotide sequence of an exemplary construct comprising a gene encoding lacZ, and an exemplary FNR promoter, P$_{fnr3}$ ((SEQ ID NO: 230). The construct comprises a transcriptional fusion of the Nissle nirB gene and the lacZ gene, in which the transcriptional fusions use only the promoter region fused to a strong ribosomal binding site. The P$_{fnr3}$ sequence is bolded lower case, and the predicted ribosome binding site within the promoter is underlined. The lacZ sequence is underlined upper case. ATG site is bolded upper case, and the cloning sites used to synthesize the construct are shown in regular upper case.

Table 55 shows the nucleotide sequence of an exemplary construct comprising a gene encoding lacZ, and an exemplary FNR promoter, P$_{fnr4}$ ((SEQ ID NO: 2318). The construct comprises a transcriptional fusion of the Nissle ydJZ gene and the lacZ gene. The P$_{fnr4}$ sequence is bolded lower case, and the predicted ribosome binding site within the promoter is underlined. The lacZ sequence is underlined upper case. ATG site is bolded upper case, and the cloning sites used to synthesize the construct are shown in regular upper case.

Table 56 shows the nucleotide sequence of an exemplary construct comprising a gene encoding lacZ, and an exemplary FNR promoter, PfnrS ((SEQ ID NO: 232). The construct comprises a transcriptional fusion of the anaerobically induced small RNA gene, fnrS1, fused to lacZ. The P$_{fnrs}$ sequence is bolded lower case, and the predicted ribosome binding site within the promoter is underlined. The lacZ sequence is underlined upper case. ATG site is bolded upper case, and the cloning sites used to synthesize the construct are shown in regular upper case.

TABLE 52

Pfnr1-lacZ construct Sequences
Nucleotide sequences of Pfnr1-lacZ
construct, low-copy (SEQ ID NO: 228)

GGTACC**gtcagcataacaccctgacctctcattaattgttcat
gccgggcggcactatcgtcgtccggccttttcctctcttactc
tgctacgtacatctatttctataaatccgttcaatttgtctgt
ttttgcacaaacatgaaatatcagacaattccgtgacttaag
aaaatttatacaaatcagcaatataccccttaaggagtatata
aaggtgaatttgatttacatcaataagcggggttgctgaatcg
ttaaggtaggcggtaatagaaaagaaatcgaggcaaaa**ATGag
caaagtcagactcgcaattatGGATCCTCTGGCCGTCGTATTA TABLE 52-continued Pfnr1-lacZ construct Sequences
Nucleotide sequences of Pfnr1-lacZ
construct, low-copy (SEQ ID NO: 228)

CAACGTCGTGACTGGGAAAACCCTGGCGTTACCCAACTTAATC
GCCTTGCGGCACATCCCCCTTTCGCCAGCTGGCGTAATAGCGA
AGAGGCCCGCACCGATCGCCCTTCCCAACAGTTGCGCAGCCTG
AATGGCGAATGGCGCTTTGCCTGGTTTCCGGCACCAGAAGCGG
TGCCGGAAAGCTGGCTGGAGTGCGATCTTCCTGACGCCGATAC
TGTCGTCGTCCCCTCAAACTGGCAGATGCACGGTTACGATGCG
CCTATCTACACCAACGTGACCTATCCCATTACGGTCAATCCGC
CGTTTGTTCCCGCGGAGAATCCGACAGGTTGTTACTCGCTCAC
ATTTAATATTGATGAAAGCTGGCTACAGGAAGGCCAGACGCGA
ATTATTTTTGATGGCGTTAACTCGGCGTTTCATCTGTGGTGCA
ACGGGCGCTGGGTCGGTTACGGCCAGGACAGCCGTTTGCCGTC
TGAATTTGACCTGAGCGCATTTTTACGCGCCGGAGAAAACCGC
CTCGCGGTGATGGTGCTGCGCTGGAGTGACGGCAGTTATCTGG
AAGATCAGGATATGTGGCGGATGAGCGGCATTTTCCGTGACGT
CTCGTTGCTGCATAAACCGACCACGCAAATCAGCGATTTCCAA
GTTACCACTCTCTTTAATGATGATTTCAGCCGCGCGGTACTGG
AGGCAGAAGTTCAGATGTACGGCGAGCTGCGCGATGAACTGCG
GGTGACGGTTTCTTTGTGGCAGGGTGAAACGCAGGTCGCCAGC
GGCACCGCGCCTTTCGGCGGTGAAATTATCGATGAGCGTGGCG
GTTATGCCGATCGCGTCACACTACGCCTGAACGTTGAAAATCC
GGAACTGTGGAGCGCCGAAATCCCGAATCTCTATCGTGCAGTG
GTTGAACTGCACACCGCCGACGGCACGCTGATTGAAGCAGAAG
CCTGCGACGTCGGTTTCCGCGAGGTGCGGATTGAAAATGGTCT
GCTGCTGCTGAACGGCAAGCCGTTGCTGATTCGCGGCGTTAAC
CGTCACGAGCATCATCCTCTGCATGGTCAGGTCATGGATGAGC
AGACGATGGTGCAGGATATCCTGCTGATGAAGCAGAACAACTT
TAACGCCGTGCGCTGTTCGCATTATCCGAACCATCCGCTGTGG
TACACGCTGTGCGACCGCTACGGCCTGTATGTGGTGGATGAAG
CCAATATTGAAACCCACGGCATGGTGCCAATGAATCGTCTGAC
CGATGATCCGCGCTGGCTACCCGCGATGAGCGAACGCGTAACG
CGGATGGTCAGCGCGATCGTAATCACCCGAGTGTGATCATCT
GGTCGCTGGGGAATGAATCAGGCCACGGCGCTAATCACGACGC
GCTGTATCGCTGGATCAAATCTGTCGATCCTTCCCGCCCGGTA
CAGTATGAAGGCGGCGGAGCCGACACCACGGCCACCGATATTA
TTTGCCCGATGTACGCGCGCGTGGATGAAGACCAGCCCTTCCC
GGCGGTGCCGAAATGGTCCATCAAAAAATGGCTTTCGCTGCCT
GGAGAAATGCGCCCGCTGATCCTTTGCGAATATGCCCACGCGA
TGGGTAACAGTCTTGGCGGCTTCGCTAAATACTGGCAGGCGTT
TCGTCAGTACCCCCGTTTACAGGGCGGCTTCGTCTGGGACTGG
GTGGATCAGTCGCTGATTAAATATGATGAAAACGGCAACCCGT
GGTCGGCTTACGGCGGTGATTTTGGCGATACGCCGAACGATCG
CCAGTTCTGTATGAACGGTCTGGTCTTTGCCGACCGCACGCCG
CATCCGGCGCTGACGGAAGCAAAACACCAACAGCAGTATTTCC
AGTTCCGTTTATCCGGGCGAACCATCGAAGTGACCAGCGAATA
CCTGTTCCGTCATAGCGATAACGAGTTCCTGCACTGGATGGTG
GCACTGGATGGCAAGCCGCTGGCAAGCGGTGAAGTGCCTCTGG
ATGTTGGCCCGCAAGGTAAGCAGTTGATTGAACTGCCTGAACT
GCCGCAGCCGGAGAGCGCCGGACAACTCTGGCTAACGGTACGC
GTAGTGCAACCAAACGCGACCGCATGGTCAGAAGCCGGACACA
TCAGCGCCTGGCAGCAATGGCGTCTGGCGGAAAACCTCAGCGT
GACACTCCCCTCCGCGTCCCACGCCATCCCTCAACTGACCACC
AGCGGAACGGATTTTTGCATCGAGCTGGGTAATAAGCGTTGGC
AATTTAACCGCCAGTCAGGCTTTCTTTCACAGATGTGGATTGG
CGATGAAAACAACTGCTGACCCCGCTGCGCGATCAGTTCACC
CGTGCGCCGCTGGATAACGACATTGGCGTAAGTGAAGCGACCC
GCATTGACCCTAACGCCTGGGTCGAACGCTGGAAGGCGGCGGG
CCATTACCAGGCCGAAGCGGCGTTGTTGCAGTGCACGGCAGAT
ACACTTGCCGACGCGGTGCTGATTACAACCGCCCACGCGTGGC
AGCATCAGGGGAAAACCTTATTTATCAGCCGGAAAACCTACCG
GATTGATGGGCACGGTGAGATGGTCATCAATGTGGATGTTGCG
GTGGCAAGCGATACACCGCATCCGGCGCGGATTGGCCTGACCT
GCCAGCTGGCGCAGGTCTCAGAGCGGGTAAACTGGCTCGGCCT
GGGGCCGCAAGAAAACTATCCCGACCGCCTTACTGCAGCCTGT
TTTGACCGCTGGGATCTGCCATTGTCAGACATGTATACCCCGT
ACGTCTTCCCGAGCGAAAACGGTCTGCGCTGCGGGACGCGCGA
ATTGAATTATGGCCCACACCAGTGGCGCGGCGACTTCCAGTTC
AACATCAGCCGCTACAGCCAACAACAACTGATGGAAACCAGCC
ATCGCCATCTGCTGCACGCGGAAGAAGGCACATGGCTGAATAT
CGACGGTTTCCATATGGGGATTGGTGGCGACGACTCCTGGAGC
CCGTCAGTATCGGCGAATTCCAGCTGAGCGCCGGTCGCTACC
ATTACCAGTTGGTCTGGTGTCAAAAATAA

TABLE 53

Pfnr2-lacZ construct sequences
Nucleotide sequences of Pfnr2-lacZ
construct, low-copy (SEQ ID NO: 229)

GGTACCcatttcctctcatcccatccggggtgagagtcttttcc
cccgacttatggctcatgcatgcatcaaaaaagatgtgagcttg
atcaaaaacaaaaaatatttcactcgacaggagtatttatattg
cgcccgttacgtgggcttcgactgtaaatcagaaaggagaaaac
acctATGacgacctacgatcgGGATCCTCTGGCCGTCGTATTAC
AACGTCGTGACTGGGAAAACCCTGGCGTTACCCAACTTAATCGC
CTTGCGGCACATCCCCCTTTCGCCAGCTGGCGTAATAGCGAAGA
GGCCCGCACCGATCGCCCTTCCCAACAGTTGCGCAGCCTGAATG
GCGAATGGCGCTTTGCCTGGTTTCCGGCACCAGAAGCGGTGCCG
GAAAGCTGGCTGGAGTGCGATCTTCCTGACGCCGATACTGTCGT
CGTCCCCTCAAACTGGCAGATGCACGGTTACGATGCGCCTATCT
ACACCAACGTGACCTATCCCATTACGGTCAATCCGCCGTTTGTT
CCCGCGGAGAATCCGACAGGTTGTTACTCGCTCACATTTAATAT
TGATGAAAGCTGGCTACAGGAAGGCCAGACGCGAATTATTTTTG
ATGGCGTTAACTCGGCGTTTCATCTGTGGTGCAACGGGCGCTGG
GTCGGTTACGGCCAGGACAGCCGTTTGCCGTCTGAATTTGACCT
GAGCGCATTTTTACGCGCCGGAGAAAACCGCCTGCGATGATGGG
TGCTGCGCTGGAGTGACGGCAGTTATCTGGAAGATCAGGATATG
TGGCGGATGAGCGGCATTTTCCGTGACGTCTCGTTGCTGCATAA
ACCGACCACGCAAATCAGCGATTTCCAAGTTACCACTCTCTTTA
ATGATGATTTCAGCCGCCGGTACTGGAGGCAGAAGTTCAGATG
TACGGCGAGCTGCGCGATGAACTGCGGGTGACGGTTTCTTTGTG
GCAGGGTGAAACGCAGGTCGCCAGCGGCACCGCGCCTTTCGGCG
GTGAAATTATCGATGAGCGTGGCGGTTATGCCGATCGCGTCACA
CTACGCCTGAACGTTGAAAATCCGGAACTGTGGAGCGCCGAAAT
CCCGAATCTCTATCGTGCAGTGGTTGAACTGCACACCGCCGACG
GCACGCTGATTGAAGCAGAAGCCTGCGACGTCGGTTTCCGCGAG
GTGCGGATTGAAAATGGTCTGCTGCTGCTGAACGGCAAGCCGTT
GCTGATTCGCGGCGTTAACCGTCACGAGCATCATCCTCTGCATG
GTCAGGTCATGGATGAGCAGACGATGGTGCAGGATATCCTGCTG
ATGAAGCAGAACAACTTTAACGCCGTGCGCTGTTCGCATTATCC
GAACCATCGCTGTGGTACACGCTGTGCGACCGCTACGGCCTGT
ATGTGGTGGATGAAGCCAATATTGAAACCCACGGCATGGTGCCA
ATGAATCGTCTGACCGATGATCCGCGCTGGCTACCCGCGATGAG
CGAACGCGTAACGCGGATGGTGCAGCGCGATCGTAATCACCCGA
GTGTGATCATCTGGTCGCTGGGGAATGAATCAGGCCACGGCGCT
AATCACGACGCGCTGTATCGCTGGATCAAATCTGTCGATCCTTC
CCGCCCGGTACAGTATGAAGGCGGCGGAGCCGACACCACGGCCA
CCGATATTATTTGCCCGATGTACGCGCGCGTGGATGAAGACCAG
CCCTTCCCGGCGGTGCCGAAATGGTCCATCAAAAATGGCTTTC
GCTGCCTGGAGAAATGCGCCCGCTGATCCTTTGCGAATATGCCC
ACGCGATGGGTAACAGTCTTGGCGGCTTCGCTAAATACTGGCAG
GCGTTTCGTCAGTACCCCGTTTACAGGGCGGCTTCGTCTGGGA
CTGGGTGGATCAGTCGCTGATTAAATATGATGAAAACGGCAACC
CGTGGTCGGCTTACGGCGGTGATTTTGGCGATACGCCGAACGAT
CGCCAGTTCTGTATGAACGGTCTGGTCTTTGCCGACCGCACGCC
GCATCCGGCGCTGACGGAAGCAAAACACCAACAGCAGTATTTCC
AGTTCCGTTTATCCGGCGAACCATCGAAGTGACCAGCGAATAC
CTGTTCCGTCATAGCGATAACGAGTTCCTGCACTGGATGGTGGC
ACTGGATGGCAAGCCGCTGGCAAGCGGTGAAGTGCCTCTGGATG
TTGGCCCGCAAGGTAAGCAGTTGATTGAACTGCCTGAACTGCCG
CAGCCGGAGAGCGCCGGACAACTCTGGCTAACGGTACGCGTAGT
GCAACCAAACGCGACCGCATGGTCAGAAGCCGGACACATCAGCG
CCTGGCAGCAATGGCGTCTGGCGAAAACCTCAGCGTGACACTC
CCCTCCGCGTCCCACGCCATCCCTCAACTGACCACCAGCGGAAC
GGATTTTTGCATCGAGCTGGGTAATAAGCGTTGGCAATTTAACC
GCCAGTCAGGCTTTCTTTCACAGATGTGGATTGGCGATAAAAA
CAACTGCTGACCCCGCTGCGCGATCAGTTCACCCGTGCGCGCT
GGATAACGCATTGGCGTAAGTGAAGCGACCCGCATTGACCCTA
ACGCCTGGGTCGAACGCTGGAAGGCGGCGGGCCATTACCAGGCC
GAAGCGGCGTTGTTGCAGTGCACGGCAGATACACTTGCCGACGC
GGTGCTGATTACAACCGCCCACGCGTGGCAGCATCAGGGGAAAA
CCTTATTTATCAGCCGGAAAACCTACCGGATTGATGGGCACG
GAGATGGTCATCAATGTGGATGTTGCGGTGGCAAGCGATACACC
GCATCCGGCGCGGATTGGCCTGACCTGCCAGCTGGCGCAGGTCT
CAGAGCGGGTAAACTGGCTCGGCCTGGGGCCGCAAGAAAACTAT
CCCGACCGCCTTACTGCAGCCTGTTTTGACCGCTGGGATCTGCC
ATTGTCAGACATGTATACCCCGTACGTCTTCCCGAGCGAAAACG
GTCTGCGCTGCGGGACGCGCGAATTGAATTATGGCCCACACCAG
TGGCGCGGCGACTTCCAGTTCAACATCAGCCGCTACAGCCAACA
ACAACTGATGGAAACGCAGATCCATCGTCCATCTGCCACAGCCA
AAGGCACATGGCTGAATATCGACGGTTTCCATATGGGGATTGGT
GGCGACGACTCCTGGAGCCCGTCAGTATCGGCGGAATTCCAGCT
GAGCGCCGGTCGCTACCATTACCAGTTGGTCTGGTGTCAAAAAT
AA

TABLE 54

Pfnr3-lacZ construct Sequences
Nucleotide sequences of Pfnr3-lacZ
construct, low-copy (SEQ ID NO: 230)

GGTACCgtcagcataacaccctgacctctcattaattgttca
tgccgggcgggcactatcgtcgtccggccttttcctctcttac
tctgctacgtacatctatttctataaatccgttcaatttgtc
tgttttttgcacaaacatgaaatatcagacaattccgtgact
taagaaaatttatacaaatcagcaatataccccttaaggagt
atataaaggtgaatttgatttacatcaataagcggggttgct
gaatcgttaaGGATCCctctagaaataatttgtttaacttt
aagaaggagatatacatATGACTATGATTACGGATTCTCTGG
CCGTCGTATTACAACGTCGTGACTGGGAAAACCCTGGCGTTA
CCCAACTTAATCGCCTTGCGGCACATCCCCCTTTCGCCAGCT
GGCGTAATAGCGAAGAGGCCCGCACCGATCGCCCTTCCCAAC
AGTTGCGCAGCCTGAATGGCGAATGGCGCTTTGCCTGGTTTC
CGGCACCAGAAGCGGTGCCGGAAAGCTGGCTGGAGTGCGATC
TTCCTGACGCCGATACTGTCGTCGTCCCCTCAAACTGGCAGA
TGCACGGTTACGATGCGCCTATCTACACCAACGTGACCTATC
CCATTACGGTCAATCCGCCGTTTGTTCCCGCGGAGAATCCGA
CAGGTTGTTACTCGCTCACATTTAATATTGATGAAAGCTGGC
TACAGGAAGGCCAGACGCGAATTATTTTTGATGGCGTTAACT
CGGCGTTTCATCTGTGGTGCAACGGGCGCTGGGTCGGTTACG
GCCAGGACAGCCGTTTGCCGTCTGAATTTGACCTGAGCGCAT
TTTTACGCGCCGGAGAAAACCGCCTCGCGGTGATGGTGCTG
GCTGGAGTGACGGCAGTTATCTGGAAGATCAGGATATGTGGC
GGATGAGCGGCATTTTCCGTGACGTCTCGTTGCTGCATAAAC
CGACCACGCAAATCAGCGATTTCCAAGTTACCACTCTCTTTA
ATGATGATTTCAGCCGCGCGGTACTGGAGGCAGAAGTTCAGA
TGTACGGCGAGCTGCGCGATGAACTGCGGGTGACGGTTTCTT
TGTGGCAGGGTGAAACGCAGGTCGCCAGCGGCACCGCGCCTT
TCGGCGGTGAAATTATCGATGAGCGTGGCGGTTATGCCGATC
GCGTCACACTACGCCTGAACGTTGAAAATCCGGAACTGTGGA
GCGCGAAATCCCGAATCTCTATCGTGCAGTGGTTGAACTGCA
CACCGCCGACGGCACGCTGATTGAAGCAGAAGCCTGCGACG
TCGGTTTCGCGAGGTGCGGATTGAAAATGGTCTGCTGCTGC
TGAACGGCAAGCCGTTGCTGATTCGCGGCGTTAACCGTCACG
AGCATCATCCTCTGCATGGTCAGGTCATGGATGAGCAGACGA
TGGTGCAGGATATCCTGCTGATGAAGCAGAACAACTTTAACG
CCGTGCGCTGTTCGCATTATCCGAACCATCCGCTGTGGTACA
CGCTGTGCGACCGCTACGGCCTGTATGTGGTGGATGAAGCCA
ATATTGAAACCCACGGCATGGTGCCAATGAATCGTCTGACCG
ATGATCCGCGCTGGCTACCCGCGATGAGCGAACGCGTAACGC
GGATGGTGCAGCGCGATCGTAATCACCCGAGTGTGATCATCT
GGTCGCTGGGGAATGAATCAGGCCACGGCGCTAATCACGACG
CGCTGTATCGCTGGATCAAATCTGTCGATCCTTCCCGCCCGG
TACAGTATGAAGGCGGCGGAGCCGACACCACGGCCACCGATA
TTATTTGCCCGATGTACGCGCGCGTGGATGAAGACCAGCCCT
TCCCGGCGGTGCCGAAATGGTCCATCAAAAATGGCTTTCGC
TGCCTGGAGAAATGCGCCCGCTGATCCTTTGCGAATATGCCC
ACGCGATGGGTAACAGTCTTGGCGGCTTCGCTAAATACTGGC
AGGCGTTTCGTCAGTACCCCGTTTACAGGGCGGCTTCGTCT
GGGACTGGGTGGATCAGTCGCTGATTAAATATGATGAAAACG
GCAACCCGTGGTCGGCTTACGGCGGTGATTTTGGCGATACGC
CGAACGATCGCCAGTTCTGTATGAACGGTCTGGTCTTTGCCG
ACCGCACGCCGCATCCGGCGCTGACGGAAGCAAAACACCAAC
AGCAGTATTTCCAGTTCCGTTTATCCGGGCGAACCATCGAAG
TGACCAGCGAATACCTGTTCCGTCATAGCGATAACGAGTTCC
TGCACTGGATGGTGGCACTGGATGGCAAGCCGCTGGCAAGCG
GTGAAGTGCCTCTGGATGTTGGCCCGCAAGGTAAGCAGTTGA
TTGAACTGCCTGAACTGCCGCAGCCGGAGAGCGCCGGACAAC
TCTGGCTAACGGTACGCGTAGTGCAACCAAACGCGACCGCAT
GGTCAGAAGCCGGACACATCAGCGCCTGGCAGCAATGGCGTC
TGGCGAAAACCTCAGCGTGACACTCCCCTCCGCGTCCCACG
CCATCCCTCAACTGACCACCAGCGGAACGGATTTTTGCATCG
AGCTGGGTAATAAGCGTTGGCAATTTAACCGCCAGTCAGGCT
TTCTTTCACAGATGTGGATTGGCGATAAAAACAACTGCTGA
CCCCGCTGCGCGATCAGTTCACCCGTGCGCCGCTGGATAACG
ACATTGGCGTAAGTGAAGCGACCCGCATTGACCCTAACGCCT
GGGTCGAACGCTGGAAGGCGGCGGGCCATTACCAGGCCGAAG
CGGCGTTGTTGCAGTGCACGGCAGATACACTTGCCGACGCGG
TGCTGATTACAACCGCCCACGCGTGGCAGCATCAGGGGAAAA
CCTTATTTATCAGCCGGAAAACCTACCGGATTGATGGGCACG
GTGAGATGGTCATCAATGTGGATGTTGCGGTGGCAAGCGATA
CACCGCATCCGGCGCGGATTGGCCTGACCTGCCAGCTGGCGC
AGGTCTCAGAGCGGGTAAACTGGCTCGGCCTGGGGCCGCAAG
AAAACTATCCCGACCGCCTTACTGCAGCCTGTTTTGACCGCT
GGGATCTGCCATTGTCAGACATGTATACCCCGTACGTCTTCC
CGAGCGAAAACGGTCTGCGCTGCGGGACGCGCGAATTGAATT
ATGGCCCACACCAGTGGCGCGGCGACTTCCAGTTCAACATCA

TABLE 54-continued

Pfnr3-lacZ construct Sequences
Nucleotide sequences of Pfnr3-lacZ
construct, low-copy (SEQ ID NO: 230)

GCCGCTACAGCCAACAACAACTGATGGAAACCAGCCATCGCC
ATCTGCTGCACGCGGAAGAAGGCACATGGCTGAATATCGACG
GTTTCCATATGGGGATTGGTGGCGACGACTCCTGGAGCCCGT
CAGTATCGGCGGAATTCCAGCTGAGCGCCGGTCGCTACCATT
ACCAGTTGGTCTGGTGTCAAAAATAA

TABLE 55

Pfnr4-lacZ construct Sequences
Nucleotide sequences of Pfnr4-lacZ
construct, low-copy (SEQ ID NO: 231)

GGTACCcatttcctctcatccatccggggtgagagtctttt
cccccgacttatggctcatgcatgcatcaaaaaagatgtgag
cttgatcaaaaacaaaaaatatttcactcgacaggagtattt
atattgcgcccGGATCCctctagaaataattttttgtttaactt
taagaaggagatatacatATGACTATGATTACGGATTCTCTG
GCCGTCGTATTACAACGTCGTGACTGGGAAAACCCTGGCGT
ACCCAACTTAATCGCCTTGCAGCACATCCCCCTTTCGCCAGC
TGGCGTAATAGCGAAGAGGCCCGCACCGATCGCCCTTCCCAA
CAGTTGCGCAGCCTGAATGGCGAATGGCGCTTTGCCTGGTTT
CCGGCACCAGAAGCGGTGCCGGAAAGCTGGCTGGAGTGCGAT
CTTCCTGACGCCGATACTGTCGTCGTCCCCTCAAACTGGCAG
ATGCACGGTTACGATGCGCCTATCTACACCAACGTGACCTAT
CCCATTACGGTCAATCCGCCGTTTGTTCCCGCGGAGAATCCG
ACAGGTTGTTACTCGCTCACATTTAATATTGATGAAAGCTGG
CTACAGGAAGGCCAGACGCGAATTATTTTTGATGGCGTTAAC
TCGGCGTTTCATCTGTGGTGCAACGGGCGCTGGGTCGGTTAC
GGCCAGGACAGCCGTTTGCCGTCTGAATTTGACCTGAGCGCA
TTTTTACGCGCCGGAGAAAACCGCCTCGCGGTGATGGTGCTG
CGCTGGAGTGACGGCAGTTATCTGGAAGATCAGGATATGTGG
CGGATGAGCGGCATTTTCCGTGACGTCTCGTTGCTGCATAAA
CCGACCACGCAAATCAGCGATTTCCAAGTTACCACTCTCTTT
AATGATGATTTCAGCCGCGCGGTACTGGAGGCAGAAGTTCAG
ATGTACGGCGAGCTGCGCGATGAACTGCGGGTGACGGTTTCT
TTGTGGCAGGGTGAAACGCAGGTCGCCAGCGGCACCGCGCCT
TTCGGCGGTGAAATTATCGATGAGCGTGGCGGTTATGCCGAT
CGCGTCACACTACGCCTGAACGTTGAAAATCCGGAACTGTGG
AGCGCCGAAATCCCGAATCTCTATCGTGCAGTGGTTGAACTG
CACACCGCCGACGGCACGCTGATTGAAGCAGAAGCCTGCGAC
GTCGTTTCCGCGAGGTGCGGATTGAAAATGGTCTGCTGCTG
CTGAACGGCAAGCCGTTGCTGATTCGCGGCGTTAACCGTCAC
GAGCATCATCCTCTGCATGGTCAGGTCATGGATGAGCAGACG
ATGGTGCAGGATATCCTGCTGATGAAGCAGAACAACTTTAAC
GCCGTGCGCTGTTCGCATTATCCGAACCATCGCTGTGGTAC
ACGCTGTGCGACCGCTACGGCCTGTATGTGGTGGATGAAGCC
AATATTGAAACCCACGGCATGGTGCCAATGAATCGTCTGACC
GATGATCCGCGCTGGCTACCCGCGATGAGCGAACGCCACCGGCG
CGGATGGTGCAGCGCGATCGTAATCACCCGAGTGTGATCATC
TGGTCGCTGGGGAATGAATCAGGCCACGGCGCTAATCACGAC
GCGCTGTATCGCTGGATCAAATCTGTCGATCCTTCCCGCCCG
GTACAGTATGAAGGCGGCGGAGCCGACACCACGGCCACCGAT
ATTATTTGCCCGATGTACGCGCGCGTGGATGAAGACCAGCCC
TTCCCGGCGGTGCCGAAATGGTCCATCAAAAAATGGCTTTCG
CTGCCTGGAGAAATGCGCCCGCTGATCCTTTGCGAATATGCC
CACGCGATGGGTAACAGTCTTGGCGGTTTCGCTAAATACTGG
CAGGCGTTTCGTCAGTACCCCCGTTTACAGGGCGGCTTCGTC
TGGGACTGGGTGGATCAGTCGCTGATTAAATATGATGAAAAC
GGCAACCCGTGGTCGGCTTACGGCGGTGATTTTGGCGATACG
CCGAACGATCGCCAGTTCTGTATGAACGGTCTGGTCTTTGCC
GACCGCACGCCGCATCCGGCGCTGACGGAAGCAAAACACCAA
CAGCAGTATTTCCAGTTCCGTTTATCGGGCAACCATCGAA
GTGACCAGCGAATACCTGTTCCGTCATAGCGATAACGAGTTC
CTGCACTGGATGGTGGCACTGGATGGTAAGCCGCTGGCAAGC
GGTGAAGTGCCTCTGGATGTTGGCCCCGCAAGGTAAGCAGTTG
ATTGAACTGCCTGAACTGCCGCAGCCGGAGAGCGCCGGACAA
CTCTGGCTAACGGTACGCGTAGTGCAACCAAACGCGACCGCA
TGGTCAGAAGCCGGACACATCAGGTGCTGACGCCGAATGGCGT
CTGGCGGAAAACTCAGCGTGACACTCCCCTCCGCGTCCCAC
GCCATCCCTCAACTGACCACCAGCGGAACGGATTTTTGCATC
GAGCTGGGTAATAAGCGTTGGCAATTTAACCGCCAGTCAGGC
TTTCTTTCACAGATGTGGATTGGCGATAAAAACAACTGCTG
ACCCCGCTGCGCGATCAGTTCACCCGTGCGCCGCTGGATAAC

TABLE 55-continued

Pfnr4-lacZ construct Sequences
Nucleotide sequences of Pfnr4-lacZ
construct, low-copy (SEQ ID NO: 231)

GACATTGGCGTAAGTGAAGCGACCCGCATTGACCCTAACGCC
TGGGTCGAACGCTGGAAGGCGGCGGGCCATTACCAGGCCGAA
GCGGCGTTGTTGCAGTGCACGGCAGATACACTTGCCGACGCG
GTGCTGATTACAACCGCCCACGCGTGGCAGCATCAGGGGAAA
ACCTTATTTATCAGCCGGAAAACCTACCGGATTGATGGGCAC
GGTGAGATGGTCATCAATGTGGATGTTGCGGTGGCAAGCGAT
ACACCGCATCCGGCGCGGATTGGCCTGACCTGCCAGCTGGCG
CAGGTCTCAGAGCGGGTAAACTGGCTCGGCCTGGGGCCGCAA
GAAAACTATCCCGACCGCCTTACTGCAGCCTGTTTTGACCGC
TGGGATCTGCCATTGTCAGACATGTATACCCCGTACGTCTTC
CCGAGCGAAAACGGTCTGCGCGTGCGGGACGCGCGAATTGAAT
TATGGCCCACACCAGTGGCGCGGCGACTTCCAGTTCAACATC
AGCCGCTACAGCCAACAACAACTGATGGAAACCAGCCATCGC
CATCTGCTGCACGCGGAAGAAGGCACATGGCTGAATATCGAC
GGTTTCCATATGGGGATTGGTGGCGACGACTCCTGGAGCCCG
TCAGTATCGGCGGAATTCCAGCTGAGCGCCGGTCGCTACCAT
TACCAGTTGGTCTGGTGTCAAAAATAA

TABLE 56

Pfnrs-lacZ construct Sequences
Nucleotide sequences of Pfnrs-lacZ
construct, low-copy (SEQ ID NO: 232)

GGTACCagttgttcttattggtggtgttgctttatggttgcatc
gtagtaaatggttgtaacaaaagcaattttttccggctgtctgta
tacaaaaaacgccgtaaagtttgagcgaagtcaataaactctcta
cccattcagggcaatatctctcttGGATCCctctagaaataatt
ttgtttaactttaagaaggagatatacatATGCTATGATTACGG
ATTCTCTGGCCGTCGTATTACAACGTCGTGACTGGGAAAACCCT
GGCTTACCCAACTTAATCGCCTTGCAGCACATCCCCCTTTCGC
CAGCTGGCGTAATAGCGAAGAGGCCCGCACCGATCGCCCTTCCC
AACAGTTGCGCAGCCTGAATGGCGAATGGCGCTTTGCCTGGTTT
CCGGCACCAGAAGCGGTGCCGGAAAGCTGGCTGGAGTGCGATCT
TCCTGACGCCGATACTGTCGTCGTCCCCTCAAACTGGCAGATGC
ACGGTTACGATGCGCCTATCTACACCAACGTGACCTATCCCATT
ACGGTCAATCCGCCGTTTGTTCCCGCGGAGAATCCGACAGGTTG
TTACTCGCTCACATTTAATATTGATGAAAGCTGGCTACAGGAAG
GCCAGACGCGAATTATTTTTGATGGCGTTAACTCGGCGTTTCAT
CTGTGGTGCAACGGGCGCTGGGTCGGTTACGGCCAGGACAGCCG
TTTGCCGTCTGAATTTGACCTGAGCGCATTTTTACGCGCCGGAG
AAAACCGCCTCGCGGTGATGGTGCTGCGCTGGAGTGACGGCAGT
TATCTGGAAGATCAGGATATGTGGCGGATGAGCGGCATTTTCCG
TGACGTCTCGTTGCTGCATAAACCGACCACGCAAATCAGCGATT
TCCAAGTTACCACTCTCTTTAATGATGATTTCAGCCGCGCGGTA
CTGGAGGCAGAAGTTCAGATGTACGGCGAGCTGCGCGATGAACT
GCGGGTGACGGTTTCTTTGTGGCAGGGTGAAACGCAGGTCGCCA
GCGGCACCGCGCCTTTCGGCGGTGAAATTATCGATGAGCGTGGC
GGTTATGCCGATCGCGTCACACTACGCCTGAACGTTGAAAATCC
GGAACTGTGGAGCGCCGAAATCCCGAATCTCTATCGTGCAGTGG
TTGAACTGCACACCGCCGACGGCACGCTGATTGAAGCAGAAGCC
TGCGACGTCGTTTCCGCGAGGTGCGGATTGAAAATGGTCTGCT
GCTGCTGAACGGCAAGCCGTTGCTGATTCGCGGCGTTAACCGTC
ACGAGCATCATCCTCTGCATGGTCAGGTCATGGATGAGCAGACG
ATGGTGCAGGATATCCTGCTGATGAAGCAGAACAACTTTAACGC
CGTGCGCTGTTCGCATTATCCGAACCATCGCTGTGGTACACGG
TGTGCGACCGCTACGGCCTGTATGTGGTGGATGAAGCCAATATT
GAAACCCACGGCATGGTGCCAATGAATCGTCTGACCGATGATCC
GCGCTGGCTACCCGCGATGAGCGAACGCGTAACGCGGATGGTGC
AGCGCGATCGTAATCACCCGAGTGTGATCATCTGGTCGCTGGGG
AATGAATCAGGCCACGGCGCTAATCACGACGCGCTGTATCGCTG
GATCAAATCTGTCGATCCTTCCCGCCCGGTACAGTATGAAGGCG
GCGGAGCCGACACCACGGCCACCGATATTATTTGCCCGATGTAC
GCGCGCGTGGATGAAGACCAGCCCTTCCCGGCGGTGCCGAAATG
GTCCATCAAAAAATGGCTTTCGCTGCCTGGAGAAATGCGCCCGC
TGATCCTTTGCGAATATGCCCACGCGATGGGTAACAGTCTTGGC
GGTTCGCTAAATACTGGCAGGCGTTTCGTCAGTACCCCCGTTT
ACAGGGCGGCTTCGTCTGGGACTGGGTGGATCAGTCGCTGATTA
AATATGATGAAAACGGCAACCCGTGGTCGGCTTACGGCGGTGAT
TTTGGCGATACGCCGAACGATCGCCAGTTCTGTATGAACGGTCT
GGTCTTTGCCGACCGCACGCCGCATCCGGCGCTGACGGAAGCAA
AACACCAACAGCAGTATTTCCAGTTCCGTTTATCCGGGCAACC
ATCGAAGTGACCAGCGAATACCTGTTCCGTCATAGCGATAACGA TABLE 56-continued Pfnrs-lacZ construct Sequences
Nucleotide sequences of Pfnrs-lacZ
construct, low-copy (SEQ ID NO: 232)

```
GTTCCTGCACTGGATGGTGGCACTGGATGGCAAGCCGCTGGCAA
GCGGTGAAGTGCCTCTGGATGTTGGCCCGCAAGGTAAGCAGTTG
ATTGAACTGCCTGAACTGCCGCAGCCGGAGAGCGCCGGACAACT
CTGGCTAACGGTACGCGTAGTGCAACCAAACGCGACCGCATGGT
CAGAAGCCGGACACATCAGCGCCTGGCAGCAATGGCGTCTGGCG
GAAAACCTCAGCGTGACACTCCCCTCCGCGTCCCACGCCATCCC
TCAACTGACCACCAGCGGAACGGATTTTTGCATCGAGCTGGGTA
ATAAGCGTTGGCAATTTAACCGCCAGTCAGGCTTTCTTTCACAG
ATGTGGATTGGCGATGAAAAACAACTGCTGACCCCGCTGCGCGA
TCAGTTCACCCGTGCGCCGCTGGATAACGACATTGGCGTAAGTG
AAGCGACCCGCATTGACCCTAACGCCTGGGTCGAACGCTGGAAG
GCGGCGGGCCATTACCAGGCCGAAGCGGCGTTGTTGCAGTGCAC
GGCAGATACACTTGCCGACGCGGTGCTGATTACAACCGCCCACG
CGTGGCAGCATCAGGGGAAAACCTTATTTATCAGCCGGAAAACC
TACCGGATTGATGGGCACGGTGAGATGGTCATCAATGTGGATGT
TGCGGTGGCAAGCGATACACCGCATCCGGCGCGGATTGGCCTGA
CCTGCCAGCTGGCGCAGGTCTCAGAGCGGGTAAACTGGCTCGGC
CTGGGGCCGCAAGAAAACTATCCCGACCGCCTTACTGCAGCCTG
TTTTGACCGCTGGGATCTGCCATTGTCAGACATGTATACCCCGT
ACGTCTTCCCGAGCGAAAACGGTCTGCGCTGCGGGACGCGCGAA
TTGAATTATGGCCCACACCAGTGGCGCGGCGACTTCCAGTTCAA
CATCAGCCGCTACAGCCAACAACAACTGATGGAAACCAGCCATC
GCCATCTGCTGCACGCGGAAGAAGGCACATGGCTGAATATCGAC
GGTTTCCATATGGGGATTGGTGGCGACGACTCCTGGAGCCCGTC
AGTATCGGCGAATTCCAGCTGAGCGCCGGTCGCTACCATTACC
AGTTGGTCTGGTGTCAAAAATAA
```

Example 40

TABLE 57

Other Sequences of interest

| | |
|---|---|
| Wild-type clbA (SEQ ID NO: 233) | caaatatcacataatcttaacatatcaataaacacagtaaagtttcatgtgaaaaacat caaacataaaatacaagctcggaatacgaatcacgctatacacattgctaacagga atgagattatctaaatgaggattgatatattaattggacatactagtttttttcatcaaac cagtagagataacttccttcactatctcaatgaggaagaaataaaacgctatgatca gtttcattttgtgagtgataaagaactctatattttaagccgtatcctgctcaaaacagc actaaaaagatatcaacctgatgtctcattacaatcatggcaatttagtacgtgcaaat atggcaaaccatttatagttttttcctcagttggcaaaaaagatttttttttaaccttttcccat actatagatacagtagccgttgctattagttctcactgcgagcttggtgtcgatattga acaaataagagatttagacaactcttatctgaatatcagtcagcatttttttactccaca ggaagctactaacatagtttcacttcctcgttatgaaggtcaattacttttttggaaaat gtggacgctcaaagaagcttacatcaaatatcgaggtaaaggcctatctttaggact ggattgtattgaatttcatttaacaaataaaaaactaacttcaaaatatagaggttcacc tgtttatttctctcaatggaaaatatgtaactcatttctcgcattagcctctccactcatca cccctaaaataactattgagctatttcctatgcagtcccaactttatcaccacgactatc agctaattcattcgtcaaatgggcagaattgaatcgccacggataatctagacacttc tgagccgtcgataatattgatttcatattccgtcggtggtgtaagtatcccgcataatc gtgccattcacatttag |
| clbA knock-out (SEQ ID NO: 234) | ggatgggggaaacatggataagttcaaagaaaaaaacccgttatctctgcgtgaaa gacaagtattgcgcatgctggcacaaggtgatgagtactctcaaatatcacataatctt aacatatcaataaacacagtaaagtttcatgtgaaaaacatcaaacataaaatacaagc tcggaatacgaatcacgctatacacattgctaacaggaatgagattatctaaatgagga ttgaTGTGTAGGCTGGAGCTGCTTCGAAGTTCCTATAC TTTCTAGAGAATAGGAACTTCGGAATAGGAACTTCG GAATAGGAACTAAGGAGGATATTCATATGtcgtcaaatggg cagaattgaatcgccacggataatctagacacttctgagccgtcgataatattgattttc atattccgtcggtgg |

SEQUENCE LISTING (242 sequences)

SEQ ID NO: 1 - DNA, 1575 bp, Artificial Sequence
  source: /note="Description of Artificial Sequence: Synthetic polynucleotide"
atgcgcaaagtgccgattatcacggctgacgaggccgcaaaactgatcaaggacggcgacaccgtgacaactagcggctttgtgggtaacgcgatccctgaggcccttgaccgtgcagtcgaaaagcgtttcctggaaacgggcgaaccgaagaacattacttatgtatattgcggcagtcagggcaatcgcgacggtcgtggcgcagaacatttcgcgcatgaaggcctgctgaaacgttatatcgctggccattgggcgaccgtcccggcgttagggaaaatggccatggagaataaaatggaggcctacaatgtctctcagggcgccttgtgtcatctctttcgcgatattgcgagccataaaccgggtgtgttcacgaaagtaggaatcggcaccttcattgatccacgtaacggtggtgggaaggtcaacgatattaccaaggaagatatcgtagaactggtggaaattaaagggcaggaatacctgttttatccggcgttcccgatccatgtcgcgctgattcgtggcacctatgcggacgagagtggtaacatcacctttgaaaaagaggtagcgcctttggaagggacttctgtctgtcaagcggtgaagaactcgggtggcattgtcgtggttcaggttgagcgtgtcgtcaaagcaggcacgctggatccgcgccatgtgaaagttccgggtatctatgtagattacgtagtcgtcgcggatccggaggaccatcaacagtcccttgactgcgaatatgatcctgcccttagtggagagcaccgtcgtccggaggtggtgggtgaaccactgcctttatccgcgaagaaagtcatcggccgccgtggcgcgattgagctcgagaaagacgttgcagtgaaccttggggtaggtgcacctgagtatgtggcctccgtggccgatgaagaaggcattgtggattttatgactctcacagcggagtccggcgctatcggtggcgttccagccggcggtgttcgctttggggcgagctacaatgctgacgccttgatcgaccagggctaccaatttgattattacgacggtgggggtctggatctttgttacctgggtttagctgaatgcgacgaaaagggtaatatcaatgttagccgcttcggtcctcgtatcgctgggtgcggcggattcattaacattacccaaaacacgccgaaagtcttcttttgtgggacctttacagccggggggctgaaagtgaaaattgaagatggtaaggtgattatcgttcaggaagggaaacagaagaaattccttaaggcagtggagcaaatcacctttaatggagacgtggccttagcgaacaagcaacaagttacctacatcacggagcgttgcgtcttcctcctcaaagaagacggtttacacctttcggaaatcgcgccaggcatcgatctgcagacccagattttggatgttatggactttgccccgatcattgatcgtgacgcaaacgggcagattaaactgatggacgcggcgttattcgcagaagggctgatgggcttgaaagaaatgaagtcttaa

SEQ ID NO: 2 - DNA, 1269 bp, Artificial Sequence
  source: /note="Description of Artificial Sequence: Synthetic polynucleotide"
atgagcttaacccaaggcatgaaagctaaacaactgttagcatactttcagggtaaagccgatcaggatgcacgtgaagcgaaagcccgcggtgagctggtctgctggtcggcgtcagtcgcgccgccggaattttgcgtaacaatgggcattgccatgatctacccggagactcatgcagcgggcatcggtgcccgcaaaggtgcgatggacatgctggaagttgcggaccgcaaaggctacaacgtggattgttgttcctacggccgtgtaaatatgggttacatggaatgtttaaaagaagccgccatcacgggcgtcaagccggaagttttggttaattcccctgctgctgacgttccgcttcccgatttggtgattacgtgtaataatatctgtaacacgctgctgaaatggtacgaaaacttagcagcagaactcgatattccttgcatcgtgatcgacgtaccgtttaatcataccatgccgattccggaatatgccaaggcctacatcgcggaccagttccgcaatgcaatttctcagctggaagttatttgtggccgtccgttcgattggaagaaatttaaggaggtcaaagatcagacccagcgtagcgtataccactggaaccgcattgccgagatggcgaaatacaagcctagcccgctgaacggcttcgatctgttcaattacatggcgttaatcgtggcgtgccgcagcctggattatgcagaaattacctttaaagcgttcgcggacgaattagaagagaatttgaaggcgggtatctacgcctttaaaggtgcggaaaaaacgcgctttcaatgggaaggtatcgcggtgtggccacatttaggtcacacgtttaaatctatgaagaatctgaattcgattatgaccggtacggcataccccgccctttgggacctgcactatgacgctaacgacgaatctatgcactctatggctgaagcgtacacccgtatttatattaatacttgtctgcagaacaaagtagaggtcctgcttgggatcatggaaaaaggccaggtggatggtaccgtatatcatctgaatcgcagctgcaaactgatgagtttcctgaacgtggaaacggctgaaattattaaagagaagaacggtcttccttacgtctccattgatggcgatcagaccgatcctcgcgttttttctccggcccagtttgatacccgtgttcaggccctggttgagatgatggaggccaatatggcggcagcggaataa

SEQ ID NO: 3 - DNA, 1125 bp, Artificial Sequence
  source: /note="Description of Artificial Sequence: Synthetic polynucleotide"
atgtcacgcgtggaggcaatcctgtcgcagctgaaagatgtcgccgcgaatccgaaaaaagccatggatgactataaagctgaaacaggtaagggcgcggttggtatcatgccgatctacagccccgaagaaatggtacacgccgctggctatttgccgatgggaatctggggcgcccagggcaaaacgattagtaaagcgcgcacctatctgcctgcttttgcctgcagcgtaatgcagcaggttatggaattacagtgcgagggcgcgtatgatgacctgtccgcagttatttttagcgtaccgtgcgacactctcaaatgtcttagccagaaatggaaaggtacgtccccagtgattgtatttacgcatccgcagaaccgcggattagaagcggcgaaccaattcttggttaccgagtatgaactggtaaaagcacaactggaatcagttctgggtgtgaaaatttcaaacgccgccctggaaaattcgattgcaatttataacgagaatcgtgccgtgatgcgtgagttcgtgaaagtggcagcggactatcctcaagtcattgacgcagtgagccgccacgcggtttttaaagcgcgccagtttatgcttaaggaaaaacataccgcacttgtgaaagaactgatcgctgagattaaagcaacgccagtccagccgtgggacggaaaaaaggttgtagtgacgggcattctgttggaaccgaatgagttattagatatctttaatgagtttaagatcgcgattgttgatgatgatttagcgcaggaaagccgtcagatccgtgttgacgttctggacggagaaggcggaccgctctaccgtatggctaaagcgtggcagcaaatgtatggctgctcgctggcaaccgacaccaagaagggtcgcggccgtatgttaattaacaaaacgattcagaccggtgcggacgctatcgtagttgcaatgatgaagttttgcgacccagaagaatgggattatccggtaatgtaccgtgaatttgaagaaaaaggggtcaaatcacttatgattgaggtggatcaggaagtatcgtctttcgaacagattaaaacccgtctgcagtcattcgtcgaaatgctttaa

SEQ ID NO: 4 - DNA, 779 bp, Artificial Sequence
  source: /note="Description of Artificial Sequence: Synthetic polynucleotide"
atgtataccttggggattgatgtcggttctgcctctagtaaagcggtgattctgaaagatggaaaagatattgtcgctgccgaggttgtccaagtcggtaccggctcctcgggtccccaacgcgcactggacaaagcctttgaagtctctggcttaaaaaaggaagacatcagctacacagtagctacgggctatgggcgcttcaattttagcgacgcggataaacagatttcggaaattagctgtcatgccaaaggcatttatttcttagtaccaactgcgcgcactattattgacattggcggccaagatgcgaaagccatccgcctggacgacaaggggggtattaagcaattcttcatgaatgataaatgcgcggcgggcacggggcgtttcctggaagtcatggctcgcgtacttgaaaccaccctggatgaaatggctgaactggatgaacaggcgactgacaccgctcccatttcaagcacctgcacggttttcgccgaaagcgaagtaattagccaattgagcaatggtgtctcacgcaacaacatcattaaaggtgtccatctgagcgttgcgtcacgtgcgtgtggtctggcgtatcgcggcggtttggagaaagatgttgttatgacaggtggcgtggcaaaaaatgcaggggtggtgcgcgcggtggcgggcgttctgaagaccgatgttatcgttgctccgaatcctcagacgaccggtgcactgggggcagcgctgtatgcttatgaggccgcccagaagaagta

SEQ ID NO: 5 - DNA, 1104 bp, Artificial Sequence
  source: /note="Description of Artificial Sequence: Synthetic polynucleotide"
atggccttcaatagcgcagatattaattctttccgcgatatttgggtgttttgtgaacagcgtgagggcaaactgattaacaccgatttcgaattaattagcgaaggtcgtaaactggctgacgaacgcggaagcaaactggttggaattttgctggggcacgaagttgaagaaatcgcaaaagaattaggcggctatggtgcggacaaggtaattgtgtgcgatcatccggaacttaaattttacactacggatgcttatgccaaagttttatgtgacgtcgtgatggaagagaaaccggaggtaattttgatcggtgccaccaacattggccgtgatctcggaccgcgttgtgctgcacgcttgcacacggggctgacggctgattgcacgcacctggatattgatatgaataaatatgtggactttcttagcaccagtagcaccttggatatctcgtcgatgactttccctatggaagatacaaaccttaaaatgacgcgccctgcatttggcggacatctgatggcaacgatcatttgtccacgcttccgtccctgtatgagcacagtgcgccccggagtgatgaagaaagcggagttctcgcaggagatggcgcaagcatgtcaagtagtgacccgtcacgtaaatttgtcggatgaagaccttaaaactaaagtaattaatatcgtgaaggaaacgaaaaagattgtggatctgatcggcgcagaaattattgtgtcagttggtcgtggtatctcgaaagatgtccaaggtggaattgcactggctgaaaaacttgcggacgcatttggtaacggtgtcgtgggcggctcgcgcgcagtgattgattccggctggttacctgcggatcatcaggttggacaaaccggtaagaccgtgcacccgaaagtctacgtggcgctgggtattagtggggctatccagcataaggctgggatgcaagactctgaactgatcattgccgtcaacaaagacgaaacggcgcctatcttcgactgcgccgattatggcatcaccggtgatttatttaaaatcgtaccgatgatgatcgacgcgatcaaagagggtaaaaacgcatga

SEQ ID NO: 6 - DNA, 804 bp, Artificial Sequence
  source: /note="Description of Artificial Sequence: Synthetic polynucleotide"
atgcgcatctatgtgtgtgtgaaacaagtcccagatacgagcggcaaggtggccgttaaccctgatgggacccttaaccgtgcctcaatggcagcgattattaacccggacgatatgtccgcgatcgaacaggcattaaaactgaaagatgaaaccggatgccaggttacggcgcttacgatgggtcctcctcctgccgagggcatgttgcgcgaaattattgcaatgggggccgacgatggtgtgctgatttcggcccgtgaatttggggggtccgataccttcgcaaccagtcaaattattagcgcggcaatccataaattaggcttaagcaatgaagacatgatcttttgcggtcgtcaggccattgacggtgatacggcccaagtcggccctcaaattgccgaaaaactgagcatcccacaggtaacctatggcgcaggaatcaaaaaatctggtgatttagtgctggtgaagcgtatgttggaggatggttatatgatgatcgaagtcgaaactccatgtctgattacctgcattcaggataaagcggtaaaaccacgttacatgactctcaacggtattatggaatgctactccaagccgctcctcgttctcgattacgaagcactgaaagatgaaccgctgatcgaacttgataccattgggcttaaaggctccccgacgaatatctttaaatcgtttacgccgcctcagaaaggcgttggtgtcatgctccaaggcaccgataaggaaaaagtcgaggatctggtggataagctgatgcagaaacatgtcatctaa

SEQ ID NO: 7 - DNA, 1185 bp, Artificial Sequence
  source: /note="Description of Artificial Sequence: Synthetic polynucleotide"
atgttcttactgaagattaaaaaagaacgtatgaaacgcatggactttagtttaacgcgtgaacaggagatgttaaaaaaactggcgcgtcagtttgctgagatcgagctggaaccggtggccgaagagattgatcgtgagcacgtttttcctgcagaaaactttaagaagatggcggaaattggcttaaccggcattggtatcccgaaagaatttggtggctccggtggaggcaccctggagaaggtcattgccgtgtcagaattcggcaaaaagtgtatggcctcagcttccattttaagcattcatcttatcgcgccgcaggcaatctacaaatatgggaccaaagaacagaaagagacgtacctgccgcgtcttaccaaaggtggtgaactgggcgcctttgcgctgacagaaccaaacgccggaagcgatgccggcgcggtaaaaacgaccgcgattctggacagccagacaaacgagtacgtgctgaatggcaccaaatgctttatcagcgggggcgggcgcgcgggtgttcttgtaatttttgcgcttactgaaccgaaaaaaggtctgaaagggatgagcgcgattatcgtggagaaagggaccccgggcttcagcatcggcaaggtggagagcaagatggggatcgcaggttcggaaaccgcggaacttatcttcgaagattgtcgcgttccggctgccaaccttttaggtaaagaaggcaaaggctttaaaattgctatggaagccctggatggcgcccgtattggcgtgggcgctcaagcaatcggaattgccgagggggcgatcgacctgagtgtgaagtacgttcacgagcgcattcaatttggtaaaccgatcgcgaatctgcagggaattcaatggtatatcgcggatatggcgaccaaaaccgccgcggcacgcgcacttgttgagtttgcagcgtatcttgaagacgcgggtaaaccgttcacaaaggaatctgctatgtgcaagctgaacgcctccgaaaacgcgcgttttgtgacaaatttagctctgcagattcacgggggttacggttatatgaaagattatccgttagagcgtatgtatcgcgatgctaagattacggaaatttacgaggggacatcagaaatccataaggtggtgattgcgcgtgaagtaatgaaacgctaa

SEQ ID NO: 8 - DNA, 2463 bp, Artificial Sequence
  source: /note="Description of Artificial Sequence: Synthetic polynucleotide"
atgcgagtgttgaagttcggcggtacatcagtggcaaatgcagaacgttttctgcgtgttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttttgacgggactcgccgccgcccagccggggttcccgctggcgcaattgaaaactttcgtcgatcaggaatttgcccaaataaaacatgtcctgcatggcattagtttgttggggcagtgcccggatagcatcaacgctgcgctgatttgccgtggcgagaaaatgtcgatcgccattatggccggcgtattagaagcgcgcggtcacaacgttactgttatcgatccggtcgaaaaactgctggcagtggggcattacctcgaatctaccgtcgatattgctgagtccacccgccgtattgcggcaagccgcattccggctgatcacatggtgctgatggcaggtttcaccgccggtaatgaaaaaggcgaactggtggtgcttggacgcaacggttccgactactctgctgcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccggggatgaaagggatggtcggcatggcggcgcgcgtctttgcagcgatgtcacgcgcccgtatttccgtggtgctgattacgcaatcatcttccgaatacagcatcagtttctgcgttccacaaagcgactgtgtgcgagctgaacgggcaatgcaggaagagttctacctggaactgaaagaaggcttactggagccgctggcagtgacggaacggctggccattatctcggtggtaggtgatggtatgcgcaccttgcgtgggatctcggcgaaattctttgccgcactggcccgcgccaatatcaacattgtcgccattgctcagagatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggctgaagaataaacatatcgacttacgtgtctgcggtgttgccaactcgaaggctctgctcaccaatgtacatggccttaatctggaaaactggcaggaagaactggcgcaagccaaagagccgtttaatctcgggcgcttaattcgcctcgtgaaagaatatcatctgctgaacccggtcattgttgactgcacttccagccaggcagtggcggatcaatatgccgacttcctgcgcgaaggtttccacgttgtcacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgcaggtgatgaattgatgaagttctccggcattctttctggttcgctttcttatatcttcggcaagttagacgaaggcatgagtttctccgaggcgaccacgctggcgcgggaaatgggttataccgaaccggacccgcgagatgatctttctggtatggatgtggcgcgtaaactattgattctcgctcgtgaaacgggacgtgaactggagctggcggatattgaaattgaacctgtgctgcccgcagagtttaacgccgagggtgatgttgccgcttttatggcgaatctgtcacaactcgacgatctctttgccgcgcgcgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctga

SEQ ID NO: 9 - DNA, 933 bp, Artificial Sequence
  source: /note="Description of Artificial Sequence: Synthetic polynucleotide"
atggttaaagtttatgccccggcttccagtgccaatatgagcgtcgggtttgatgtgctcggggcggcggtgacacctgttgatggtgcattgctcggagatgtagtcacggttgaggcggcagagacattcagtctcaacaacctcggacgctttgccgataagctgccgtcagaaccacgggaaaatatcgtttatcagtgctgggagcgtttttgccaggaactgggtaagcaaattccagtggcgatgaccctggaaaagaatatgccgatcggttcgggcttaggctccagtgcctgttcggtggtcgcggcgctgatggcgatgaatgaacactgcggcaagccgcttaatgacactcgtttgctggctttgatgggcgagctggaaggccgtatctccggcagcattcattacgacaacgtggcaccgtgttttctcggtggtatgcagttgatgatcgaagaaaacgacatcatcagccagcaagtgccagggtttgatgagtggctgtgggtgctggcgtatccggggattaaagtctcgacggcagaagccagggctattttaccggcgcagtatcgccgccaggattgcattgcgcacgggcgacatctggcaggcttcattcacgcctgctattcccgtcagcctgagcttgccgcgaagctgatgaaagatgttatcgctgaaccctaccgtgaacggttactgccaggcttccggcaggcgcggcaggcggtcgcggaaatcggcgcggtagcgagcggtatctccggctccggcccgaccttgttcgctctgtgtgacaagccggaaaccgcccagcgcgttgccgactggttgggtaagaactacctgcaaaatcaggaaggttttgttcatatttgccggctggatacggcgggcgcacgagtactggaaaactaa

SEQ ID NO: 10 - DNA, 1287 bp, Artificial Sequence
  source: /note="Description of Artificial Sequence: Synthetic polynucleotide"
atgaaactctacaatctgaaagatcacaacgagcaggtcagctttgcgcaagccgtaacccaggggttgggcaaaaatcaggggctgttttttccgcacgacctgccggaattcagcctgactgaaattgatgagatgctgaagctggattttgtcacccgcagtgcgaagatcctctcggcgtttattggtgatgaaatcccacaggaaatcctggaagagcgcgtgcgcgcggcgtttgccttcccggctccggtcgccaatgttgaaagcgatgtcggttgtctggaattgttccacgggccaacgctggcatttaaagatttcggcggtcgctttatggcacaaatgctgacccatattgcgggtgataagccagtgaccattctgaccgcgacctccggtgataccggagcggcagtggctcatgctttctacggtttaccgaatgtgaaagtggttatcctctatccacgaggcaaaatcagtccactgcaagaaaaactgttctgtacattgggcggcaatatcgaaactgttgccatcgacggcgatttcgatgcctgtcaggcgctggtgaagcaggcgtttgatgatgaagaactgaaagtggcgctagggttaaactcggctaactcgattaacatcagccgtttgctggcgcagatttgctactactttgaagctgttgcgcagctgccgcaggagacgcgcaaccagctggttgtctcggtgccaagcggaaacttcggcgatttgacggcgggtctgctggcgaagtcactcggtctgccggtgaaacgttttattgctgcgaccaacgtgaacgataccgtgccacgtttcctgcacgacggtcagtggtcacccaaagcgactcaggcgacgttatccaacgcgatggacgtgagtcagccgaacaactggccgcgtgtggaagagttgttccgccgcaaaatctggcaactgaaagagctgggttatgcagccgtggatgatgaaaccacgcaacagacaatgcgtgagttaaaagaactgggctacacttcggagccgcacgctgccgtagcttatcgtgcgctgcgtgatcagttgaatccaggcgaatatggcttgttcctcggcaccgcgcatccggcgaaatttaaagagagcgtggaagcgattctcggtgaaacgttggatctgccaaaagagctggcagaacgtgctgatttacccttgctttcacataatctgcccgccgattttgctgcgttgcgtaaattgatgatgaatcatcagtaa

SEQ ID NO: 11 - DNA, 1311 bp, Artificial Sequence
  source: /note="Description of Artificial Sequence: Synthetic polynucleotide"
atgagtgaaacatacgtgtctgagaaaagtccaggagtgatggctagcggagcggagctgattcgtgccgccgacattcaaacggcgcaggcacgaatttcctccgtcattgcaccaactccattgcagtattgccctcgtctttctgaggaaaccggagcggaaatctaccttaagcgtgaggatctgcaggatgttcgttcctacaagatccgcggtgcgctgaactctggagcgcagctcacccaagagcagcgcgatgcaggtatcgttgccgcatctgcaggtaaccatgcccagggcgtggcctatgtgtgcaagtccttgggcgttcagggacgcatctatgttcctgtgcagactccaaagcaaaagcgtgaccgcatcatggttcacggcggagagtttgtctccttggtggtcactggcaataacttcgacgaagcatcggctgcagcgcatgaagatgcagagcgcaccggcgcaacgctgatcgagcctttcgatgctcgcaacaccgtcatcggtcagggcaccgtggctgctgagatcttgtcgcagctgacttccatgggcaagagtgcagatcacgtgatggttccagtcggcggtggcggacttcttgcaggtgtggtcagctacatggctgatatggcacctcgcactgcgatcgttggtatcgaaccagcgggagcagcatccatgcaggctgcattgcacaatggtggaccaatcactttggagactgttgatccctttgtggacggcgcagcagtcaaacgtgtcggagatctcaactacaccatcgtggagaagaaccagggtcgcgtgcacatgatgagcgcgaccgagggcgctgtgtgtactgagatgctcgatctttaccaaaacgaaggcatcatcgcggagcctgctggcgcgctgtctatcgctgggttgaaggaaatgtcctttgcacctggttctgcagtggtgtgcatcatctctggtggcaacaacgatgtgctgcgttatgcggaaatcgctgagcgctccttggtgcaccgcggtttgaagcactacttcttggtgaacttcccgcaaaagcctggtcagttgcgtcacttcctggaagatatcctgggaccggatgatgacatcacgctgtttgagtacctcaagcgcaacaaccgtgagaccggtactgcgttggtgggtattcacttgagtgaagcatcaggattggattctttgctggaacgtatggaggaatcggcaattgattcccgtcgcctcgagccgggcacccctgagtacgaatacttgacctaa

SEQ ID NO: 12 - DNA, 2664 bp, Artificial Sequence
  source: /note="Description of Artificial Sequence: Synthetic polynucleotide"
atgtcagaacgtttcccaaatgacgtggatccgatcgaaactcgcgactggctccaggcgatcgaatcggtcatccgtgaagaaggtgttgagcgtgctcagtatctgatcgaccaactgcttgctgaagcccgcaaaggcggtgtaaacgtagccgcaggcacaggtatcagcaactacatcaacaccatccccgttgaagaacaaccggagtatccgggtaatctggaactggaacgccgtattcgttcagctatccgctggaacgccatcatgacggtgctgcgtgcgtcgaaaaaagacctcgaactgggcggccatatggcgtccttccagtcttccgcaaccatttatgatgtgtgctttaaccacttcttccgtgcacgcaacgagcaggatggcggcgacctggtttacttccagggccacatctccccgggcgtgtacgctcgtgctttcctggaaggtcgtctgactcaggagcagctggataacttccgtcaggaagttcacggcaatggcctctcttcctatccgcacccgaaactgatgccggaattctggcagttcccgaccgtatctatgggtctgggtccgattggtgctatttaccaggctaaattcctgaaatatctggaacaccgtggcctgaaagatacctctaaacaaaccgtttacgcgttcctcggtgacggtgaaatggacgaaccggaatccaaaggtgcgatcaccatcgctacccgtgaaaaactggataacctggtcttcgttatcaactgtaacctgcagcgtcttgacggcccggtcaccggtaacggcaagatcatcaacgaactggaaggcatcttcgaaggtgctggctggaacgtgatcaaagtgatgtggggtagccgttgggatgaactgctgcgtaaggataccagcggtaaactgatccagctgatgaacgaaaccgttgacggcgactaccagaccttcaaatcgaaagatggtgcgtacgttcgtgaacacttcttcggtaaatatcctgaaaccgcagcactggttgcagactggactgacgagcagatctgggcactgaaccgtggtggtcacgatccgaagaaaatctacgctgcattcaagaaagcgcaggaaaccaaaggcaaagcgacagtaatccttgctcataccattaaaggttacggcatgggcgacgcggctgaaggtaaaaacatcgcgcaccaggttaagaaaatgaacatggacggtgtgcgtcatatccgcgaccgtttcaatgtgccggtgtctgatgcagatatcgaaaaactgccgtacatcaccttcccggaaggttctgaagagcatacctatctgcacgctcagcgtcagaaactgcacggttatctgccaagccgtcagccgaacttcaccgagaagcttgagctgccgagcctgcaagacttcggcgcgctgttggaagagcagagcaaagagatctctaccactatcgctttcgttcgtgctctgaacgtgatgctgaagaacaagtcgatcaaagatcgtctggtaccgatcatcgccgacgaagcgcgtactttcggtatggaaggtctgttccgtcagattggtatttacagcccgaacggtcagcagtacaccccgcaggaccgcgagcaggttgcttactataaagaagacgagaaaggtcagattctgcaggaagggatcaacgagctgggcgcaggttgttcctggctggcagcggcgacctcttacagcaccaacaatctgccgatgatcccgttctacatctattactcgatgttcggcttccagcgtattggcgatctgtgctgggcggctggcgaccagcaagcgcgtggcttcctgatcggcggtacttccggtcgtaccaccctgaacggcgaaggtctgcagcacgaagatggtcacagccacattcagtcgctgactatcccgaactgtatctcttacgacccggcttacgcttacgaagttgctgtcatcatgcatgacggtctggagcgtatgtacggtgaaaaacaagagaacgtttactactacatcactacgctgaacgaaaactaccacatgccggcaatgccggaaggtgctgaggaaggtatccgtaaaggtatctacaaactcgaaactattgaaggtagcaaaggtaaagttcagctgctcggctccggttctatcctgcgtcacgtccgtgaagcagctgagatcctggcgaaagattacggcgtaggttctgacgtttatagcgtgacctccttcaccgagctggcgcgtgatggtcaggattgtgaacgctggaacatgctgcacccgctggaaactccgcgcgttccgtatatcgctcaggtgatgaacgacgctccggcagtggcatctaccgactatatgaaactgttcgctgagcaggtccgtacttacgtaccggctgacgactaccgcgtactgggtactgatggcttcggtcgttccgacagccgtgagaacctgcgtcaccacttcgaagttgatgcttcttatgtcgtggttgcggcgctgggcgaactggctaaacgtggcgaaatcgataagaaagtggttgctgacgcaatcgccaaattcaacatcgatgcagataaagttaacccgcgtctggcgtaa

SEQ ID NO: 13 - DNA, 1893 bp, Artificial Sequence
  source: /note="Description of Artificial Sequence: Synthetic polynucleotide"
atggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagttccgtctccgcaggcgggtatcgttaaagagatcaaagtctctgttggcgataaaacccagaccggcgcactgattatgattttcgattccgccgacggtgcagcagacgctgcacctgctcaggcagaagagaagaaagaagcagctccggcagcagcaccagcggctgcggcggcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttccggctccgtttgctggcaccgtgaaagagatcaaagtgaacgtgggtgacaaagtgtctaccggctcgctgattatggtcttcgaagtcgcgggtgaagcaggcgcggcagctccggccgctaaacaggaagcagctccggcagcggcccctgcaccagcggctggcgtgaaagaagttaacgttccggatatcggcggtgacgaagttgaagtgactgaagtgatggtgaaagtgggcgacaaagttgccgctgaacagtcactgatcaccgtagaaggcgacaaagcttctatggaagttccggcgccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggcaccggcagcaaaagctgaagccccggcagcagcaccagctgcgaaagcggaaggcaaatctgaatttgctgaaaacgacgcttatgttcacgcgactccgctgatccgccgtctggcacgcgagtttggtgttaaccttgcgaaagtgaagggcactggccgtaaaggtcgtatcctgcgcgaagacgttcaggcttacgtgaaagaagctatcaaacgtgcagaagcagctccggcagcgactggcggtggtatccctggcatgctgccgtggccgaaggtggacttcagcaagtttggtgaaatcgaagaagtggaactgggccgcatccagaaaatctctggtgcgaacctgagccgtaactgggtaatgatcccgcatgttactcacttcgacaaaaccgatatcaccgagttggaagcgttccgtaaacagcagaacgaagaagcggcgaaacgtaagctggatgtgaagatcaccccggttgtcttcatcatgaaagccgttgctgcagctcttgagcagatgcctcgcttcaatagttcgctgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctgggtactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaa

SEQ ID NO: 14 - DNA, 1425 bp, Artificial Sequence
  source: /note="Description of Artificial Sequence: Synthetic polynucleotide"
atgagtactgaaatcaaaactcaggtcgtggtacttggggcaggccccgcaggttactccgctgccttccgttgcgctgatttaggtctggaaaccgtaatcgtagaacgttacaacacccttggcggtgtttgcctgaacgtcggctgtatcccttctaaagcactgctgcacgtagcaaaagttatcgaagaagccaaagcgctggctgaacacggtatcgtcttcggcgaaccgaaaaccgatatcgacaagattcgtacctggaaagagaaagtgatcaatcagctgaccggtggtctggctggtatggcgaaaggccgcaaagtcaaagtggtcaacggtctgggtaaattcaccggggctaacaccctggaagttgaaggtgagaacggcaaaaccgtgatcaacttcgacaacgcgatcattgcagcgggttctcgcccgatccaactgccgtttattccgcatgaagatccgcgtatctgggactccactgacgcgctggaactgaaagaagtaccagaacgcctgctggtaatgggtggcggtatcatcggtctggaaatgggcaccgtttaccacgcgctgggttcacagattgacgtggttgaaatgttcgaccaggttatcccggcagctgacaaagacatcgttaaagtcttcaccaagcgtatcagcaagaaattcaacctgatgctggaaaccaaagttaccgccgttgaagcgaaagaagacggcatttatgtgacgatggaaggcaaaaaagcacccgctgaaccgcagcgttacgacgccgtgctggtagcgattggtcgtgtgccgaacggtaaaaacctcgacgcaggcaaagcaggcgtggaagttgacgaccgtggtttcatccgcgttgacaaacagctgcgtaccaacgtaccgcacatctttgctatcggcgatatcgtcggtcaaccgatgctggcacacaaaggtgttcacgaaggtcacgttgccgctgaagttatcgccggtaagaaacactacttcgatccgaaagttatcccgtccatcgcctataccaaaccagaagttgcatgggtgggtctgactgagaaagaagcgaaagagaaaggcatcagctatgaaaccgccaccttcccgtgggctgcttctggtcgtgctatcgcttccgactgcgcagacggtatgaccaagctgattttcgacaaagaatctcaccgtgtgatcggtggtgcgattgtcggtactaacggcggcgagctgctgggtgaaatcggcctggcaatcgaaatgggttgtgatgctgaagacatcgcactgaccatccacgcgcacccgactctgcacgagtctgtgggcctggcggcagaagtgttcgaaggtagcattaccgacctgccgaacccgaaagcgaagaagaagtaa

SEQ ID NO: 15 - DNA, 861 bp, Artificial Sequence
  source: /note="Description of Artificial Sequence: Synthetic polynucleotide"
atgagtcaggcgctaaaaaatttactgacattgttaaatctggaaaaaattgaggaaggactctttcgcggccagagtgaagatttaggtttacgccaggtgtttggcggccaggtcgtgggtcaggccttgtatgctgcaaaagagaccgtccctgaagagcggctggtacattcgtttcacagctactttcttcgccctggcgatagtaagaagccgattatttatgatgtcgaaacgctgcgtgacggtaacagcttcagcgcccgccgggttgctgctattcaaaacggcaaaccgattttttatatgactgcctctttccaggcaccagaagcgggtttcgaacatcaaaaaacaatgccgtccgcgccagcgcctgatggcctcccttcggaaacgcaaatcgcccaatcgctggcgcacctgctgccgccagtgctgaaagataaattcatctgcgatcgtccgctggaagtccgtccggtggagtttcataacccactgaaaggtcacgtcgcagaaccacatcgtcaggtgtggatccgcgcaaatggtagcgtgccggatgacctgcgcgttcatcagtatctgctcggttacgcttctgatcttaacttcctgccggtagctctacagccgcacggcatcggttttctcgaaccggggattcagattgccaccattgaccattccatgtggttccatcgcccgtttaatttgaatgaatggctgctgtatagcgtggagagcacctcggcgtccagcgcacgtggctttgtgcgcggtgagttttatacccaagacggcgtactggttgcctcgaccgttcaggaaggggtgatgcgtaatcacaattaa

SEQ ID NO: 16 - DNA, 981 bp, Artificial Sequence
  source: /note="Description of Artificial Sequence: Synthetic polynucleotide"
atgcgtgcggtactgatcgagaagtccgatgatacacagtccgtctctgtcaccgaactggctgaagatcaactgccggaaggcgacgttttggtagatgttgcttattcaacactgaactacaaagacgccctggcaattaccggtaaagcccccgtcgttcgtcgttttccgatggtacctggaatcgactttacgggtaccgtggcccagtcttcccacgccgacttcaagccaggtgatcgcgtaatcctgaatggttggggtgtgggggaaaaacattggggcggtttagcggagcgcgctcgcgtgcgcggagactggcttgttcccttgccagcccccctggacttacgccaagcggccatgatcggtacagcaggatacacggcgatgttgtgcgttctggcgcttgaacgtcacggagtggtgccgggtaatggggaaatcgtggtgtccggtgcagcaggcggcgtcggctccgttgcgacgacccttcttgccgctaagggctatgaggtagcggcagtgactggacgtgcgtccgaagcagaatatctgcgcggtttgggggcggcgagcgtaattgatcgtaacgaattaacggggaaggtacgcccgctgggtcaggagcgttgggctggcgggattgacgtggcgggatcaaccgtgcttgcgaacatgctttctatgatgaagtatcgcggggtagtcgctgcgtgtggcctggccgcgggcatggatctgcccgcgtctgtcgcgccctttattcttcgtgggatgacgctggcaggggtggatagcgttatgtgcccaaagacagatcgtttagcagcgtgggcccgtttggcgtcagatcttgaccctgccaagctggaggagatgactacagagttgccgtttagtgaagtaatcgagacagcacccaaattcttggacgggacggttcgtggccgcattgttatccccgtaacgccctaa

SEQ ID NO: 17 - DNA, 2145 bp, Artificial Sequence
  source: /note="Description of Artificial Sequence: Synthetic polynucleotide"
atgtctaacgtgcaggagtggcaacagcttgccaacaaggaattgagccgtcgggagaaaactgtcgactcgctggttcatcaaaccgcggaagggatcgccatcaagccgctgtataccgaagccgatctcgataatctggaggtgacaggtacccttcctggtttgccgccctacgttcgtggcccgcgtgccactatgtataccgcccaaccgtggaccatccgtcagtatgctggtttttcaacagcaaaagagtccaacgctttttatcgccgtaacctggccgccgggcaaaaaggtctttccgttgcgtttgaccttgccacccaccgtggctacgactccgataacccgcgcgtggcgggcgacgtcggcaaagcgggcgtcgctatcgacaccgtggaagatatgaaagtcctgttcgaccagatcccgctggataaaatgtcggtttcgatgaccatgaatggcgcagtgctaccagtactggcgttttatatcgtcgccgcagaagagcaaggtgttacacctgataaactgaccggcaccattcaaaacgatattctcaaagagtacctctgccgcaacacctatatttacccaccaaaaccgtcaatgcgcattatcgccgacatcatcgcctggtgttccggcaacatgccgcgatttaataccatcagtatcagcggttaccacatgggtgaagcgggtgccaactgcgtgcagcaggtagcatttacgctcgctgatgggattgagtacatcaaagcagcaatctctgccggactgaaaattgatgacttcgctcctcgcctgtcgttcttcttcggcatcggcatggatctgtttatgaacgtcgccatgttgcgtgcggcacgttatttatggagcgaagcggtcagtggatttggcgcacaggacccgaaatcactggcgctgcgtacccactgccagacctcaggctggagcctgactgaacaggatccgtataacaacgttatccgcaccaccattgaagcgctggctgcgacgctgggcggtactcagtcactgcataccaacgcctttgacgaagcgcttggtttgcctaccgatttctcagcacgcattgcccgcaacacccagatcatcatccaggaagaatcagaactctgccgcaccgtcgatccactggccggatcctattacattgagtcgctgaccgatcaaatcgtcaaacaagccagagctattatccaacagatcgacgaagccggtggcatggcgaaagcgatcgaagcaggtctgccaaaacgaatgatcgaagaggcctcagcgcgcgaacagtcgctgatcgaccagggcaagcgtgtcatcgttggtgtcaacaagtacaaactggatcacgaagacgaaaccgatgtacttgagatcgacaacgtgatggtgcgtaacgagcaaattgcttcgctggaacgcattcgcgccacccgtgatgatgccgccgtaaccgccgcgttgaacgccctgactcacgccgcacagcataacgaaaacctgctggctgccgctgttaatgccgctcgcgttcgcgccaccctgggtgaaatttccgatgcgctggaagtcgctttcgaccgttatctggtgccaagccagtgtgttaccggcgtgattgcgcaaagctatcatcagtctgagaaatcggcctccgagttcgatgccattgttgcgcaaacggagcagttccttgccgacaatggtcgtcgcccgcgcattctgatcgctaagatgggccaggatggacacgatcgcggcgcgaaagtgatcgccagcgcctattccgatctcggtttcgacgtagatttaagcccgatgttctctacacctgaagagatcgcccgcctggccgtagaaaacgacgttcacgtagtgggcgcatcctcactggctgccggtcataaaacgctgatcccggaactggtcgaagcgctgaaaaaatggggacgcgaagatatctgcgtggtcgcgggtggcgtcattccgccgcaggattacgccttcctgcaagagcgcggcgtggcggcgatttatggtccaggtacacctatgctcgacagtgtgcgcgacgtactgaatctgataagccagcatcatgattaa

SEQ ID NO: 18 - DNA, 996 bp, Artificial Sequence
  source: /note="Description of Artificial Sequence: Synthetic polynucleotide"
atgattaatgaagccacgctggcagaaagtattcgccgcttacgtcagggtgagcgtgccacactcgcccaggccatgacgctggtggaaagccgtcacccgcgtcatcaggcactaagtacgcagctgcttgatgccattatgccgtactgcggtaacaccctgcgactgggcgttaccggcacccccggcgcggggaaaagtacctttcttgaggcctttggcatgttgttgattcgagagggattaaaggtcgcggttattgcggtcgatcccagcagcccggtcactggcggtagcattctcggggataaaacccgcatgaatgacctggcgcgtgccgaagcggcgtttattcgcccggtaccatcctccggtcatctgggcggtgccagtcagcgagcgcgggaattaatgctgttatgcgaagcagcgggttatgacgtagtgattgtcgaaacggttggcgtcgggcagtcggaaacagaagtcgcccgcatggtggactgttttatctcgttgcaaattgccggtggcggcgatgatctgcagggcattaaaaaagggctgatggaagtggctgatctgatcgttatcaacaaagacgatggcgataaccataccaatgtcgccattgcccggcatatgtacgagagtgccctgcatattctgcgacgtaaatacgacgaatggcagccacgggttctgacttgtagcgcactggaaaaacgtggaatcgatgagatctggcacgccatcatcgacttcaaaaccgcgctaactgccagtggtcgtttacaacaagtgcggcaacaacaatcggtggaatggctgcgtaagcagaccgaagaagaagtactgaatcacctgttcgcgaatgaagatttcgatcgctattaccgccagacgcttttagcggtcaaaaacaatacgctctcaccgcgcaccggcctgcggcagctcagtgaatttatccagacgcaatattttgattaa

SEQ ID NO: 19 - DNA, 786 bp, Artificial Sequence
  source: /note="Description of Artificial Sequence: Synthetic polynucleotide"
atgtcttatcagtatgttaacgttgtcactatcaacaaagtggcggtcattgagtttaactatggccgaaaacttaatgccttaagtaaagtctttattgatgatcttatgcaggcgttaagcgatctcaaccggccggaaattcgctgtatcattttgcgcgcaccgagtggatccaaagtcttctccgcaggtcacgatattcacgaactgccgtctggcggtcgcgatccgctctcctatgatgatccattgcgtcaaatcacccgcatgatccaaaaattcccgaaaccgatcatttcgatggtggaaggtagtgtttggggtggcgcatttgaaatgatcatgagttccgatctgatcatcgccgccagtacctcaaccttctcaatgacgcctgtaaacctcggcgtcccgtataacctggtcggcattcacaacctgacccgcgacgcgggcttccacattgtcaaagagctgatttttaccgcttcgccaatcaccgcccagcgcgcgctggctgtcggcatcctcaaccatgttgtggaagtggaagaactggaagatttcaccttacaaatggcgcaccacatctctgagaaagcgccgttagccattgccgttatcaaagaagagctgcgtgtactgggcgaagcacacaccatgaactccgatgaatttgaacgtattcaggggatgcgccgcgcggtgtatgacagcgaagattaccaggaagggatgaacgctttcctcgaaaaacgtaaacctaatttcgttggtcattaa

SEQ ID NO: 20 - DNA, 1479 bp, Artificial Sequence
  source: /note="Description of Artificial Sequence: Synthetic polynucleotide"
atggaaactcagtggacaaggatgaccgccaatgaagcggcagaaattatccagcataacgacatggtggcatttagcggctttaccccggcgggttcgccgaaagccctacccaccgcgattgcccgcagagctaacgaacagcatgaggccaaaaagccgtatcaaattcgccttctgacgggtgcgtcaatcagcgccgccgctgacgatgtactttctgacgccgatgctgtttcctggcgtgcgccatatcaaacatcgtccggtttacgtaaaaagatcaatcagggcgcggtgagtttcgttgacctgcatttgagcgaagtggcgcaaatggtcaattacggtttcttcggcgacattgatgttgccgtcattgaagcatcggcactggcaccggatggtcgagtctggttaaccagcgggatcggtaatgcgccgacctggctgctgcgggcgaagaaagtgatcattgaactcaatcactatcacgatccgcgcgttgcagaactggcggatattgtgattcctggcgcgccaccgcggcgcaatagcgtgtcgatcttccatgcaatggatcgcgtcggtacccgctatgtgcaaatcgatccgaaaaagattgtcgccgtcgtggaaaccaacttgcccgacgccggtaatatgctggataagcaaaatcccatgtgccagcagattgccgataacgtggtcacgttcttattgcaggaaatggcgcatgggcgtattccgccggaatttctgccgctgcaaagtggcgtgggcaatatcaataatgcggtaatggcgcgtctgggggaaaacccggtaattcctccgtttatgatgtattcggaagtgctacaggaatcggtggtgcatttactggaaaccggcaaaatcagcggggccagcgcctccagcctgacaatctcggccgattccctgcgcaagatttacgacaatatggattactttgccagccgcattgtgttgcgtccgcaggagatttccaataacccggaaatcatccgtcgtctgggcgtcatcgctctgaacgtcggcctggagtttgatatttacgggcatgccaactcaacacacgtagccggggtcgatctgatgaacggcatcggcggcagcggtgattttgaacgcaacgcgtatctgtcgatctttatggccccgtcgattgctaaagaaggcaagatctcaaccgtcgtgccaatgtgcagccatgttgatcacagcgaacacagcgtcaaagtgatcatcaccgaacaagggatcgccgatctgcgcggtctttccccgcttcaacgcgcccgcactatcattgataattgtgcacatcctatgtatcgggattatctgcatcgctatctggaaaatgcgcctggcggacatattcaccacgatcttagccacgtcttcgacttacaccgtaatttaattgcaaccggctcgatgctgggttaa

SEQ ID NO: 21 - DNA, 1917 bp, Artificial Sequence
  source: /note="Description of Artificial Sequence: Synthetic polynucleotide"
atgagcagcacggatcaggggaccaaccccgccgacactgacgacctcactcccaccacactcagtctggccggggatttccccaaggccactgaggagcagtgggagcgcgaagttgagaaggtattcaaccgtggtcgtccaccggagaagcagctgaccttcgccgagtgtctgaagcgcctgacggttcacaccgtcgatggcatcgacatcgtgccgatgtaccgtccgaaggacgcgccgaagaagctgggttaccccggcgtcacccccttcacccgcggcaccacggtgcgcaacggtgacatggatgcctgggacgtgcgcgccctgcacgaggatcccgacgagaagttcacccgcaaggcgatccttgaagacctggagcgtggcgtcacctccctgttgttgcgcgttgatcccgacgcgatcgcacccgagcacctcgacgaggtcctctccgacgtcctgctggaaatgaccaaggtggaggtcttcagccgctacgaccagggtgccgccgccgaggccttgatgggcgtctacgagcgctccgacaagccggcgaaggacctggccctgaacctgggcctggatcccatcggcttcgcggccctgcagggcaccgagccggatctgaccgtgctcggtgactgggtgcgccgcctggcgaagttctcaccggactcgcgcgccgtcacgatcgacgcgaacgtctaccacaacgccggtgccggcgacgtggcagagctcgcttgggcactggccaccggcgcggagtacgtgcgcgccctggtcgaacagggcttcaacgccacagaggccttcgacacgatcaacttccgtgtcaccgccacccacgaccagttcctcacgatcgcccgtcttcgcgccctgcgcgaggcatgggcccgcatcggcgaggtctttggcgtggacgaggacaagcgcggcgctcgccagaatgcgatcaccagttggcgtgagctcacccgcgaagacccctatgtcaacatccttcgcggttcgattgccaccttctccgcctccgttggcggggccgagtcgatcacgacgctgcccttcacccaggccctcggcctgccggaggacgacttcccgctgcgcatcgcgcgcaacacgggcatcgtgctcgccgaagaggtgaacatcggccgcgtcaacgacccggccggtggctcctactacgtcgagtcgctcactcgcaccctggccgacgctgcctggaaggaattccaggaggtcgagaagctcggtggcatgtcgaaggcggtcatgaccgagcacgtcaccaaggtgctcgacgcctgcaatgccgagcgcgccaagcgcctggccaaccgcaagcagccgatcaccgcggtcagcgagttcccgatgatcggggcccgcagcatcgagaccaagccgttcccaaccgctccggcgcgcaagggcctggcctggcatcgcgattccgaggtgttcgagcagctgatggatcgctccaccagcgtctccgagcgccccaaggtgttccttgcctgcctgggcacccgtcgcgacttcggtggccgcgagggcttctccagcccggtatggcacatcgccggtatcgacaccccgcaggtcgaaggcggcaccaccgccgagatcgtcgaggcgttcaagaagtcgggcgcccaggtggccgatctctgctcgtccgccaagatctacgcgcagcagggacttgaggttgccaaggcgctcaaggccgccggcgcgaaggccctgtatctgtcgggcgccttcaaggagttcggcgatgacgccgccgaggccgagaagctgatcgacggacgcctgtacatgggcatggatgtcgtcgacaccctgtcctccacccttgatatcttgggagtcgcgaagtga

SEQ ID NO: 22 - DNA, 2187 bp, Artificial Sequence
  source: /note="Description of Artificial Sequence: Synthetic polynucleotide"
gtgagcactctgccccgttttgattcagttgacctgggcaatgccccggttcctgctgatgccgcacagcgcttcgaggagttggccgccaaggccggcaccgaagaggcgtgggagacggctgagcagattccggttggcaccctgttcaacgaagacgtctacaaggacatggactggctggacacctacgccggtatcccgccgttcgtccacggcccatatgcaaccatgtacgcgttccgtccctggacgattcgccagtacgccggcttctccacggccaaggagtccaacgccttctaccgccgcaaccttgcggcgggccagaagggcctgtcggttgccttcgacctgcccacccaccgcggctacgactcggacaatccccgcgtcgccggtgacgtcggcatggccggggtggccatcgactccatctatgacatgcgcgagctgttcgccggcattccgctggaccagatgagcgtgtcgatgaccatgaacggcgccgtgctgccgatcctggccctctatgtggtgaccgccgaggagcagggcgtcaagcccgagcagctcgccgggacgatccagaacgacatcctcaaggagttcatggttcgtaacacctatatctacccgccgcagccgagtatgcgaatcatctccgagatcttcgcctacacgagtgccaatatgccgaagtggaattcgatttccatttccggctaccacatgcaggaagccggcgccacggccgacatcgagatggcctacaccctggccgacggtgtcgactacatccgcgccggcgagtcggtgggcctcaatgtcgaccagttcgcgccgcgtctgtccttcttctggggcatcggcatgaacttcttcatggaggttgccaagctgcgtgccgcacgtatgttgtgggccaagctggtgcatcagttcgggccgaagaatccgaagtcgatgagcctgcgcacccactcgcagacctccggttggtcgctgaccgcccaggacgtctacaacaacgtcgtgcgtacctgcatcgaggccatggccgccacccagggccatacccagtcgctgcacacgaactcgctcgacgaggccattgccctaccgaccgatttcagcgcccgcatcgcccgtaacacccagctgttcctgcagcaggaatcgggcacgacgcgcgtgatcgacccgtggagcggctcggcatacgtcgaggagctcacctgggacctggcccgcaaggcatggggccacatccaggaggtcgagaaggtcggcggcatggccaaggccatcgaaaagggcatccccaagatgcgcattgaggaagccgccgcccgcacccaggcacgcatcgactccggccgtcagccgctgatcggcgtgaacaagtaccgcctggagcacgagccgccgctcgatgtgctcaaggttgacaactccacggtgctcgccgagcagaaggccaagctggtcaagctgcgcgccgagcgcgatcccgagaaggtcaaggccgccctcgacaagatcacctgggctgccgccaaccccgacgacaaggatccggatcgcaacctgctgaagctgtgcatcgacgctggccgcgccatggcgacggtcggcgagatgagcgacgcgctcgagaaggtcttcggacgctacaccgcccagattcgcaccatctccggtgtgtactcgaaggaagtgaagaacacgcctgaggttgaggaagcacgcgagctcgttgaggaattcgagcaggccgagggccgtcgtcctcgcatcctgctggccaagatgggccaggacggtcacgaccgtggccagaaggtcatcgccaccgcctatgccgacctcggtttcgacgtcgacgtgggcccgctgttccagaccccggaggagaccgcacgtcaggccgtcgaggccgatgtgcacgtggtgggcgtttcgtcgctcgccggcgggcatctgacgctggttccggccctgcgcaaggagctggacaagctcggacgtcccgacatcctcatcaccgtgggcggcgtgatccctgagcaggacttcgacgagctgcgtaaggacggcgccgtggagatctacacccccggcaccgtcattccggagtcggcgatctcgctggtcaagaaactgcgggcttcgctcgatgcctag

SEQ ID NO: 23 - DNA, 447 bp, Propionibacterium freudenreichii
atgagtaatgaggatcttttcatctgtatcgatcacgtggcatatgcgtgccccgacgccgacgaggcttccaagtactaccaggagaccttcggctggcatgagctccaccgcgaggagaacccggagcagggagtcgtcgagatcatgatggccccggctgcgaagctgaccgagcacatgacccaggttcaggtcatggccccgctcaacgacgagtcgaccgttgccaagtggcttgccaagcacaatggtcgcgccggactgcaccacatggcatggcgtgtcgatgacatcgacgccgtcagcgccaccctgcgcgagcgcggcgtgcagctgctgtatgacgagcccaagctcggcaccggcggcaaccgcatcaacttcatgcatcccaagtcgggcaagggcgtgctcatcgagctcacccagtacccgaagaactga

SEQ ID NO: 24 - DNA, 1575 bp, Artificial Sequence
  source: /note="Description of Artificial Sequence: Synthetic polynucleotide"
atggctgaaaacaacaatttgaagctcgccagcaccatggaaggtcgcgtggagcagctcgcagagcagcgccaggtgatcgaagccggtggcggcgaacgtcgcgtcgagaagcaacattcccagggtaagcagaccgctcgtgagcgcctgaacaacctgctcgatccccattcgttcgacgaggtcggcgctttccgcaagcaccgcaccacgttgttcggcatggacaaggccgtcgtcccggcagatggcgtggtcaccggccgtggcaccatccttggtcgtcccgtgcacgccgcgtcccaggacttcacggtcatgggtggttcggctggcgagacgcagtccacgaaggtcgtcgagacgatggaacaggcgctgctcaccggcacgcccttcctgttcttctacgattcgggcggcgcccggatccaggagggcatcgactcgctgagcggttacggcaagatgttcttcgccaacgtgaagctgtcgggcgtcgtgccgcagatcgccatcattgccggcccctgtgccggtggcgcctcgtattcgccggcactgactgacttcatcatcatgaccaagaaggcccatatgttcatcacgggcccccaggtcatcaagtcggtcaccggcgaggatgtcaccgctgacgaactcggtggcgctgaggcccatatggccatctcgggcaatatccacttcgtggccgaggacgacgacgccgcggagctcattgccaagaagctgctgagcttccttccgcagaacaacactgaggaagcatccttcgtcaacccgaacaatgacgtcagccccaataccgagctgcgcgacatcgttccgattgacggcaagaagggctatgacgtgcgcgatgtcattgccaagatcgtcgactggggtgactacctcgaggtcaaggccggctatgccaccaacctcgtgaccgccttcgcccgggtcaatggtcgttcggtgggcatcgtggccaatcagccgtcggtgatgtcgggttgcctcgacatcaacgcctctgacaaggccgccgaattcgtgaatttctgcgattcgttcaacatcccgctggtgcagctggtcgacgtgccgggcttcctgcccggcgtgcagcaggagtacggcggcatcattcgccatggcgcgaagatgctgtacgcctactccgaggccaccgtgccgaagatcaccgtggtgctccgcaaggcctacggcggctcctacctggccatgtgcaaccgtgaccttggtgccgacgccgtgtacgcctggcccagcgccgagattgcggtgatgggcgccgagggtgcggcaaatgtgatcttccgcaaggagatcaaggctgccgacgatcccgacgccatgcgcgccgagaagatcgaggagtaccagaacgcgttcaacacgccgtacgtggccgccgcccgcggtcaggtcgacgacgtgattgacccggctgatacccgtcgaaagattgcttccgccctggagatgtacgccaccaagcgtcagacccgcccggcgaagaagcatggaaacttcccctgctga

SEQ ID NO: 25 - DNA, 1518 bp, Propionibacterium freudenreichii
atgagtccgcgagaaattgaggtttccgagccgcgcgaggttggtatcaccgagctcgtgctgcgcgatgcccatcagagcctgatggccacacgaatggcaatggaagacatggtcggcgcctgtgcagacattgatgctgccgggtactggtcagtggagtgttggggtggtgccacgtatgactcgtgtatccgcttcctcaacgaggatccttgggagcgtctgcgcacgttccgcaagctgatgcccaacagccgtctccagatgctgctgcgtggccagaacctgctgggttaccgccactacaacgacgaggtcgtcgatcgcttcgtcgacaagtccgctgagaacggcatggacgtgttccgtgtcttcgacgccatgaatgatccccgcaacatggcgcacgccatggctgccgtcaagaaggccggcaagcacgcgcagggcaccatttgctacacgatcagcccggtccacaccgttgagggctatgtcaagcttgctggtcagctgctcgacatgggtgctgattccatcgccctgaaggacatggccgccctgctcaagccgcagccggcctacgacatcatcaaggccatcaaggacacctacggccagaagacgcagatcaacctgcactgccactccaccacgggtgtcaccgaggtctccctcatgaaggccatcgaggccggcgtcgacgtcgtcgacaccgccatctcgtccatgtcgctcggcccgggccacaaccccaccgagtcggttgccgagatgctcgagggcaccgggtacaccaccaaccttgactacgatcgcctgcacaagatccgcgatcacttcaaggccatccgcccgaagtacaagaagttcgagtcgaagacgcttgtcgacacctcgatcttcaagtcgcagatccccggcggcatgctctccaacatggagtcgcagctgcgcgcccagggcgccgaggacaagatggacgaggtcatggcagaggtgccgcgcgtccgcaaggccgccggcttcccgcccctggtcaccccgtccagccagatcgtcggcacgcaggccgtgttcaacgtgatgatgggcgagtacaagaggatgaccggcgagttcgccgacatcatgctcggctactacggcgccagcccggccgatcgcgatccgaaggtggtcaagttggccgaggagcagtccggcaagaagccgatcacccagcgcccggccgatctgctgccccccgagtgggaggagcagtccaaggaggccgcggccctcaagggcttcaacggcaccgacgaggacgtgctcacctatgcactgttcccgcaggtcgctccggtcttcttcgagcatcgcgccgagggcccgcacagcgtggctctcaccgatgcccagctgaaggccgaggccgagggcgacgagaagtcgctcgccgtggccggtcccgtcacctacaacgtgaacgtgggcggaaccgtccgcgaagtcaccgttcagcaggcgtga

SEQ ID NO: 26 - DNA, 372 bp, Artificial Sequence
  source: /note="Description of Artificial Sequence: Synthetic polynucleotide"
atgaaactgaaggtaacagtcaacggcactgcgtatgacgttgacgttgacgtcgacaagtcacacgaaaacccgatgggcaccatcctgttcggcggcggcaccggcggcgcgccggcaccgcgcgcagcaggtggcgcaggcgccggtaaggccggagagggcgagattcccgctccgctggccggcaccgtctccaagatcctcgtgaaggagggtgacacggtcaaggctggtcagaccgtgctcgttctcgaggccatgaagatggagaccgagatcaacgctcccaccgacggcaaggtcgagaaggtccttgtcaaggagcgtgacgccgtgcagggcggtcagggtctcatcaagatcggctga

SEQ ID NO: 27 - protein, 524 aa, Artificial Sequence
  source: /note="Description of Artificial Sequence: Synthetic polypeptide"
MRKVPIITADEAAKLIKDGDTVTTSGFVGNAIPEALDRAVEKRFLETGEPKNITYVYCGSQGNRDGRGAEHFAHEGLLKRYIAGHWATVPALGKMAMENKMEAYNVSQGALCHLFRDIASHKPGVFTKVGIGTFIDPRNGGGKVNDITKEDIVELVEIKGQEYLFYPAFPIHVALIRGTYADESGNITFEKEVAPLEGTSVCQAVKNSGGIVVVQVERVVKAGTLDPRHVKVPGIYVDYVVVADPEDHQQSLDCEYDPALSGEHRRPEVVGEPLPLSAKKVIGRRGAIELEKDVAVNLGVGAPEYVASVADEEGIVDFMTLTAESGAIGGVPAGGVRFGASYNADALIDQGYQFDYYDGGGLDLCYLGLAECDEKGNINVSRFGPRIAGCGGFINITQNTPKVFFCGTFTAGGLKVKIEDGKVIIVQEGKQKKFLKAVEQITFNGDVALANKQQVTYITERCVFLLKEDGLHLSEIAPGIDLQTQILDVMDFAPIIDRDANGQIKLMDAALFAEGLMGLKEMKS

SEQ ID NO: 28 - protein, 422 aa, Artificial Sequence
  source: /note="Description of Artificial Sequence: Synthetic polypeptide"
MSLTQGMKAKQLLAYFQGKADQDAREAKARGELVCWSASVAPPEFCVTMGIAMIYPETHAAGIGARKGAMDMLEVADRKGYNVDCCSYGRVNMGYMECLKEAAITGVKPEVLVNSPAADVPLPDLVITCNNICNTLLKWYENLAAELDIPCIVIDVPFNHTMPIPEYAKAYIADQFRNAISQLEVICGRPFDWKKFKEVKDQTQRSVYHWNRIAEMAKYKPSPLNGFDLFNYMALIVACRSLDYAEITFKAFADELEENLKAGIYAFKGAEKTRFQWEGIAVWPHLGHTFKSMKNLNSIMTGTAYPALWDLHYDANDESMHSMAEAYTRIYINTCLQNKVEVLLGIMEKGQVDGTVYHLNRSCKLMSFLNVETAEIIKEKNGLPYVSIDGDQTDPRVFSPAQFDTRVQALVEMMEANMAAAE

SEQ ID NO: 29 - protein, 374 aa, Artificial Sequence
  source: /note="Description of Artificial Sequence: Synthetic polypeptide"
MSRVEAILSQLKDVAANPKKAMDDYKAETGKGAVGIMPIYSPEEMVHAAGYLPMGIWGAQGKTISKARTYLPAFACSVMQQVMELQCEGAYDDLSAVIFSVPCDTLKCLSQKWKGTSPVIVFTHPQNRGLEAANQFLVTEYELVKAQLESVLGVKISNAALENSIAIYNENRAVMREFVKVAADYPQVIDAVSRHAVFKARQFMLKEKHTALVKELIAEIKATPVQPWDGKKVVVTGILLEPNELLDIFNEFKIAIVDDDLAQESRQIRVDVLDGEGGPLYRMAKAWQQMYGCSLATDTKKGRGRMLINKTIQTGADAIVVAMMKFCDPEEWDYPVMYREFEEKGVKSLMIEVDQEVSSFEQIKTRLQSFVEML

SEQ ID NO: 30 - protein, 260 aa, Artificial Sequence
  source: /note="Description of Artificial Sequence: Synthetic polypeptide"
  MOD_RES (260)..(260): Any amino acid
MYTLGIDVGSASSKAVILKDGKDIVAAEVVQVGTGSSGPQRALDKAFEVSGLKKEDISYTVATGYGRFNFSDADKQISEISCHAKGIYFLVPTARTIIDIGGQDAKAIRLDDKGGIKQFFMNDKCAAGTGRFLEVMARVLETTLDEMAELDEQATDTAPISSTCTVFAESEVISQLSNGVSRNNIIKGVHLSVASRACGLAYRGGLEKDVVMTGGVAKNAGVVRAVAGVLKTDVIVAPNPQTTGALGAALYAYEAAQKKX

SEQ ID NO: 31 - protein, 367 aa, Artificial Sequence
  source: /note="Description of Artificial Sequence: Synthetic polypeptide"
MAFNSADINSFRDIWVFCEQREGKLINTDFELISEGRKLADERGSKLVGILLGHEVEEIAKELGGYGADKVIVCDHPELKFYTTDAYAKVLCDVVMEEKPEVILIGATNIGRDLGPRCAARLHTGLTADCTHLDIDMNKYVDFLSTSSTLDISSMTFPMEDTNLKMTRPAFGGHLMATIICPRFRPCMSTVRPGVMKKAEFSQEMAQACQVVTRHVNLSDEDLKTKVINIVKETKKIVDLIGAEIIVSVGRGISKDVQGGIALAEKLADAFGNGVVGGSRAVIDSGWLPADHQVGQTGKTVHPKVYVALGISGAIQHKAGMQDSELIIAVNKDETAPIFDCADYGITGDLFKIVPMMIDAIKEGKNA

SEQ ID NO: 32 - protein, 267 aa, Artificial Sequence
  source: /note="Description of Artificial Sequence: Synthetic polypeptide"
MRIYVCVKQVPDTSGKVAVNPDGTLNRASMAAIINPDDMSAIEQALKLKDETGCQVTALTMGPPPAEGMLREIIAMGADDGVLISAREFGGSDTFATSQIISAAIHKLGLSNEDMIFCGRQAIDGDTAQVGPQIAEKLSIPQVTYGAGIKKSGDLVLVKRMLEDGYMMIEVETPCLITCIQDKAVKPRYMTLNGIMECYSKPLLVLDYEALKDEPLIELDTIGLKGSPTNIFKSFTPPQKGVGVMLQGTDKEKVEDLVDKLMQKHVI

SEQ ID NO: 33 - protein, 394 aa, Artificial Sequence
  source: /note="Description of Artificial Sequence: Synthetic polypeptide"
MFLLKIKKERMKRMDFSLTREQEMLKKLARQFAEIELEPVAEEIDREHVFPAENFKKMAEIGLTGIGIPKEFGGSGGGTLEKVIAVSEFGKKCMASASILSIHLIAPQAIYKYGTKEQKETYLPRLTKGGELGAFALTEPNAGSDAGAVKTTAILDSQTNEYVLNGTKCFISGGGRAGVLVIFALTEPKKGLKGMSAIIVEKGTPGFSIGKVESKMGIAGSETAELIFEDCRVPAANLLGKEGKGFKIAMEALDGARIGVGAQAIGIAEGAIDLSVKYVHERIQFGKPIANLQGIQWYIADMATKTAAARALVEFAAYLEDAGKPFTKESAMCKLNASENARFVTNLALQIHGGYGYMKDYPLERMYRDAKITEIYEGTSEIHKVVIAREVMKR

SEQ ID NO: 34 - protein, 820 aa, Artificial Sequence
  source: /note="Description of Artificial Sequence: Synthetic polypeptide"
MRVLKFGGTSVANAERFLRVADILESNARQGQVATVLSAPAKITNHLVAMIEKTISGQDALPNISDAERIFAELLTGLAAAQPGFPLAQLKTFVDQEFAQIKHVLHGISLLGQCPDSINAALICRGEKMSIAIMAGVLEARGHNVTVIDPVEKLLAVGHYLESTVDIAESTRRIAASRIPADHMVLMAGFTAGNEKGELVVLGRNGSDYSAAVLAACLRADCCEIWTDVDGVYTCDPRQVPDARLLKSMSYQEAMELSYFGAKVLHPRTITPIAQFQIPCLIKNTGNPQAPGTLIGASRDEDELPVKGISNLNNMAMFSVSGPGMKGMVGMAARVFAAMSRARISVVLITQSSSEYSISFCVPQSDCVRAERAMQEEFYLELKEGLLEPLAVTERLAIISVVGDGMRTLRGISAKFFAALARANINIVAIAQRSSERSISVVVNNDDATTGVRVTHQMLFNTDQVIEVFVIGVGGVGGALLEQLKRQQSWLKNKHIDLRVCGVANSKALLTNVHGLNLENWQEELAQAKEPFNLGRLIRLVKEYHLLNPVIVDCTSSQAVADQYADFLREGFHVVTPNKKANTSSMDYYHQLRYAAEKSRRKFLYDTNVGAGLPVIENLQNLLNAGDELMKFSGILSGSLSYIFGKLDEGMSFSEATTLAREMGYTEPDPRDDLSGMDVARKLLILARETGRELELADIEIEPVLPAEFNAEGDVAAFMANLSQLDDLFAARVAKARDEGKVLRYVGNIDEDGVCRVKIAEVDGNDPLFKVKNGENALAFYSHYYQPLPLVLRGYGAGNDVTAAGVFADLLRTLSWKLGV

SEQ ID NO: 35 - protein, 310 aa, Artificial Sequence
  source: /note="Description of Artificial Sequence: Synthetic polypeptide"
MVKVYAPASSANMSVGFDVLGAAVTPVDGALLGDVVTVEAAETFSLNNLGRFADKLPSEPRENIVYQCWERFCQELGKQIPVAMTLEKNMPIGSGLGSSACSVVAALMAMNEHCGKPLNDTRLLALMGELEGRISGSIHYDNVAPCFLGGMQLMIEENDIISQQVPGFDEWLWVLAYPGIKVSTAEARAILPAQYRRQDCIAHGRHLAGFIHACYSRQPELAAKLMKDVIAEPYRERLLPGFRQARQAVAEIGAVASGISGSGPTLFALCDKPETAQRVADWLGKNYLQNQEGFVHICRLDTAGARVLEN

SEQ ID NO: 36 - protein, 428 aa, Artificial Sequence
  source: /note="Description of Artificial Sequence: Synthetic polypeptide"
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQETRNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEAILGETLDLPKELAERADLPLLSHNLPADFAALRKLMMNHQ

SEQ ID NO: 37 - protein, 436 aa, Artificial Sequence
  source: /note="Description of Artificial Sequence: Synthetic polypeptide"
MSETYVSEKSPGVMASGAELIRAADIQTAQARISSVIAPTPLQYCPRLSEETGAEIYLKREDLQDVRSYKIRGALNSGAQLTQEQRDAGIVAASAGNHAQGVAYVCKSLGVQGRIYVPVQTPKQKRDRIMVHGGEFVSLVVTGNNFDEASAAAHEDAERTGATLIEPFDARNTVIGQGTVAAEILSQLTSMGKSADHVMVPVGGGGLLAGVVSYMADMAPRTAIVGIEPAGAASMQAALHNGGPITLETVDPFVDGAAVKRVGDLNYTIVEKNQGRVHMMSATEGAVCTEMLDLYQNEGIIAEPAGALSIAGLKEMSFAPGSAVVCIISGGNNDVLRYAEIAERSLVHRGLKHYFLVNFPQKPGQLRHFLEDILGPDDDITLFEYLKRNNRETGTALVGIHLSEASGLDSLLERMEESAIDSRRLEPGTPEYEYLT

SEQ ID NO: 38 - protein, 887 aa, Artificial Sequence
  source: /note="Description of Artificial Sequence: Synthetic polypeptide"
MSERFPNDVDPIETRDWLQAIESVIREEGVERAQYLIDQLLAEARKGGVNVAAGTGISNYINTIPVEEQPEYPGNLELERRIRSAIRWNAIMTVLRASKKDLELGGHMASFQSSATIYDVCFNHFFRARNEQDGGDLVYFQGHISPGVYARAFLEGRLTQEQLDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIINELEGIFEGAGWNVIKVMWGSRWDELLRKDTSGKLIQLMNETVDGDYQTFKSKDGAYVREHFFGKYPETAALVADWTDEQIWALNRGGHDPKKIYAAFKKAQETKGKATVILAHTIKGYGMGDAAEGKNIAHQVKKMNMDGVRHIRDRFNVPVSDADIEKLPYITFPEGSEEHTYLHAQRQKLHGYLPSRQPNFTEKLELPSLQDFGALLEEQSKEISTTIAFVRALNVMLKNKSIKDRLVPIIADEARTFGMEGLFRQIGIYSPNGQQYTPQDREQVAYYKEDEKGQILQEGINELGAGCSWLAAATSYSTNNLPMIPFYIYYSMFGFQRIGDLCWAAGDQQARGFLIGGTSGRTTLNGEGLQHEDGHSHIQSLTIPNCISYDPAYAYEVAVIMHDGLERMYGEKQENVYYYITTLNENYHMPAMPEGAEEGIRKGIYKLETIEGSKGKVQLLGSGSILRHVREAAEILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAIAKFNIDADKVNPRLA

SEQ ID NO: 39 - protein, 630 aa, Artificial Sequence
  source: /note="Description of Artificial Sequence: Synthetic polypeptide"
MAIEIKVPDIGADEVEITEILVKVGDKVEAEQSLITVEGDKASMEVPSPQAGIVKEIKVSVGDKTQTGALIMIFDSADGAADAAPAQAEEKKEAAPAAAPAAAAAKDVNVPDIGSDEVEVTEILVKVGDKVEAEQSLITVEGDKASMEVPAPFAGTVKEIKVNVGDKVSTGSLIMVFEVAGEAGAAAPAAKQEAAPAAAPAPAAGVKEVNVPDIGGDEVEVTEVMVKVGDKVAAEQSLITVEGDKASMEVPAPFAGVVKELKVNVGDKVKTGSLIMIFEVEGAAPAAAPAKQEAAAPAPAAKAEAPAAAPAAKAEGKSEFAENDAYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 40 - protein, 474 aa, Artificial Sequence
  source: /note="Description of Artificial Sequence: Synthetic polypeptide"
MSTEIKTQVVVLGAGPAGYSAAFRCADLGLETVIVERYNTLGGVCLNVGCIPSKALLHVAKVIEEAKALAEHGIVFGEPKTDIDKIRTWKEKVINQLTGGLAGMAKGRKVKVVNGLGKFTGANTLEVEGENGKTVINFDNAIIAAGSRPIQLPFIPHEDPRIWDSTDALELKEVPERLLVMGGGIIGLEMGTVYHALGSQIDVVEMFDQVIPAADKDIVKVFTKRISKKFNLMLETKVTAVEAKEDGIYVTMEGKKAPAEPQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTKPEVAWVGLTEKEAKEKGISYETATFPWAASGRAIASDCADGMTKLIFDKESHRVIGGAIVGTNGGELLGEIGLAIEMGCDAEDIALTIHAHPTLHESVGLAAEVFEGSITDLPNPKAKKK

SEQ ID NO: 41 - protein, 286 aa, Artificial Sequence
  source: /note="Description of Artificial Sequence: Synthetic polypeptide"
MSQALKNLLTLLNLEKIEEGLFRGQSEDLGLRQVFGGQVVGQALYAAKETVPEERLVHSFHSYFLRPGDSKKPIIYDVETLRDGNSFSARRVAAIQNGKPIFYMTASFQAPEAGFEHQKTMPSAPAPDGLPSETQIAQSLAHLLPPVLKDKFICDRPLEVRPVEFHNPLKGHVAEPHRQVWIRANGSVPDDLRVHQYLLGYASDLNFLPVALQPHGIGFLEPGIQIATIDHSMWFHRPFNLNEWLLYSVESTSASSARGFVRGEFYTQDGVLVASTVQEGVMRNHN

SEQ ID NO: 42 - protein, 326 aa, Artificial Sequence
  source: /note="Description of Artificial Sequence: Synthetic polypeptide"
MRAVLIEKSDDTQSVSVTELAEDQLPEGDVLVDVAYSTLNYKDALAITGKAPVVRRFPMVPGIDFTGTVAQSSHADFKPGDRVILNGWGVGEKHWGGLAERARVRGDWLVPLPAPLDLRQAAMIGTAGYTAMLCVLALERHGVVPGNGEIVVSGAAGGVGSVATTLLAAKGYEVAAVTGRASEAEYLRGLGAASVIDRNELTGKVRPLGQERWAGGIDVAGSTVLANMLSMMKYRGVVAACGLAAGMDLPASVAPFILRGMTLAGVDSVMCPKTDRLAAWARLASDLDPAKLEEMTTELPFSEVIETAPKFLDGTVRGRIVIPVTP

SEQ ID NO: 43 - protein, 714 aa, Artificial Sequence
  source: /note="Description of Artificial Sequence: Synthetic polypeptide"
MSNVQEWQQLANKELSRREKTVDSLVHQTAEGIAIKPLYTEADLDNLEVTGTLPGLPPYVRGPRATMYTAQPWTIRQYAGFSTAKESNAFYRRNLAAGQKGLSVAFDLATHRGYDSDNPRVAGDVGKAGVAIDTVEDMKVLFDQIPLDKMSVSMTMNGAVLPVLAFYIVAAEEQGVTPDKLTGTIQNDILKEYLCRNTYIYPPKPSMRIIADIIAWCSGNMPRFNTISISGYHMGEAGANCVQQVAFTLADGIEYIKAAISAGLKIDDFAPRLSFFFGIGMDLFMNVAMLRAARYLWSEAVSGFGAQDPKSLALRTHCQTSGWSLTEQDPYNNVIRTTIEALAATLGGTQSLHTNAFDEALGLPTDFSARIARNTQIIIQEESELCRTVDPLAGSYYIESLTDQIVKQARAIIQQIDEAGGMAKAIEAGLPKRMIEEASAREQSLIDQGKRVIVGVNKYKLDHEDETDVLEIDNVMVRNEQIASLERIRATRDDAAVTAALNALTHAAQHNENLLAAAVNAARVRATLGEISDALEVAFDRYLVPSQCVTGVIAQSYHQSEKSASEFDAIVAQTEQFLADNGRRPRILIAKMGQDGHDRGAKVIASAYSDLGFDVDLSPMFSTPEEIARLAVENDVHVVGASSLAAGHKTLIPELVEALKKWGREDICVVAGGVIPPQDYAFLQERGVAAIYGPGTPMLDSVRDVLNLISQHHD

SEQ ID NO: 44 - protein, 331 aa, Artificial Sequence
  source: /note="Description of Artificial Sequence: Synthetic polypeptide"
MINEATLAESIRRLRQGERATLAQAMTLVESRHPRHQALSTQLLDAIMPYCGNTLRLGVTGTPGAGKSTFLEAFGMLLIREGLKVAVIAVDPSSPVTGGSILGDKTRMNDLARAEAAFIRPVPSSGHLGGASQRARELMLLCEAAGYDVVIVETVGVGQSETEVARMVDCFISLQIAGGGDDLQGIKKGLMEVADLIVINKDDGDNHTNVAIARHMYESALHILRRKYDEWQPRVLTCSALEKRGIDEIWHAIIDFKTALTASGRLQQVRQQQSVEWLRKQTEEEVLNHLFANEDFDRYYRQTLLAVKNNTLSPRTGLRQLSEFIQTQYFD

SEQ ID NO: 45 - protein, 261 aa, Artificial Sequence
  source: /note="Description of Artificial Sequence: Synthetic polypeptide"
MSYQYVNVVTINKVAVIEFNYGRKLNALSKVFIDDLMQALSDLNRPEIRCIILRAPSGSKVFSAGHDIHELPSGGRDPLSYDDPLRQITRMIQKFPKPIISMVEGSVWGGAFEMIMSSDLIIAASTSTFSMTPVNLGVPYNLVGIHNLTRDAGFHIVKELIFTASPITAQRALAVGILNHVVEVEELEDFTLQMAHHISEKAPLAIAVIKEELRVLGEAHTMNSDEFERIQGMRRAVYDSEDYQEGMNAFLEKRKPNFVGH

SEQ ID NO: 46 - protein, 492 aa, Artificial Sequence
  source: /note="Description of Artificial Sequence: Synthetic polypeptide"
METQWTRMTANEAAEIIQHNDMVAFSGFTPAGSPKALPTAIARRANEQHEAKKPYQIRLLTGASISAAADDVLSDADAVSWRAPYQTSSGLRKKINQGAVSFVDLHLSEVAQMVNYGFFGDIDVAVIEASALAPDGRVWLTSGIGNAPTWLLRAKKVIIELNHYHDPRVAELADIVIPGAPPRRNSVSIFHAMDRVGTRYVQIDPKKIVAVVETNLPDAGNMLDKQNPMCQQIADNVVTFLLQEMAHGRIPPEFLPLQSGVGNINNAVMARLGENPVIPPFMMYSEVLQESVVHLLETGKISGASASSLTISADSLRKIYDNMDYFASRIVLRPQEISNNPEIIRRLGVIALNVGLEFDIYGHANSTHVAGVDLMNGIGGSGDFERNAYLSIFMAPSIAKEGKISTVVPMCSHVDHSEHSVKVIITEQGIADLRGLSPLQRARTIIDNCAHPMYRDYLHRYLENAPGGHIHHDLSHVFDLHRNLIATGSMLG

SEQ ID NO: 47 - protein, 638 aa, Artificial Sequence
  source: /note="Description of Artificial Sequence: Synthetic polypeptide"
MSSTDQGTNPADTDDLTPTTLSLAGDFPKATEEQWEREVEKVFNRGRPPEKQLTFAECLKRLTVHTVDGIDIVPMYRPKDAPKKLGYPGVTPFTRGTTVRNGDMDAWDVRALHEDPDEKFTRKAILEDLERGVTSLLLRVDPDAIAPEHLDEVLSDVLLEMTKVEVFSRYDQGAAAEALMGVYERSDKPAKDLALNLGLDPIGFAALQGTEPDLTVLGDWVRRLAKFSPDSRAVTIDANVYHNAGAGDVAELAWALATGAEYVRALVEQGFNATEAFDTINFRVTATHDQFLTIARLRALREAWARIGEVFGVDEDKRGARQNAITSWRELTREDPYVNILRGSIATFSASVGGAESITTLPFTQALGLPEDDFPLRIARNTGIVLAEEVNIGRVNDPAGGSYYVESLTRTLADAAWKEFQEVEKLGGMSKAVMTEHVTKVLDACNAERAKRLANRKQPITAVSEFPMIGARSIETKPFPTAPARKGLAWHRDSEVFEQLMDRSTSVSERPKVFLACLGTRRDFGGREGFSSPVWHIAGIDTPQVEGGTTAEIVEAFKKSGAQVADLCSSAKIYAQQGLEVAKALKAAGAKALYLSGAFKEFGDDAAEAEKLIDGRLYMGMDVVDTLSSTLDILGVAK

SEQ ID NO: 48 - protein, 728 aa, Artificial Sequence
  source: /note="Description of Artificial Sequence: Synthetic polypeptide"
VSTLPRFDSVDLGNAPVPADAAQRFEELAAKAGTEEAWETAEQIPVGTLFNEDVYKDMDWLDTYAGIPPFVHGPYATMYAFRPWTIRQYAGFSTAKESNAFYRRNLAAGQKGLSVAFDLPTHRGYDSDNPRVAGDVGMAGVAIDSIYDMRELFAGIPLDQMSVSMTMNGAVLPILALYVVTAEEQGVKPEQLAGTIQNDILKEFMVRNTYIYPPQPSMRIISEIFAYTSANMPKWNSISISGYHMQEAGATADIEMAYTLADGVDYIRAGESVGLNVDQFAPRLSFFWGIGMNFFMEVAKLRAARMLWAKLVHQFGPKNPKSMSLRTHSQTSGWSLTAQDVYNNVVRTCIEAMAATQGHTQSLHTNSLDEAIALPTDFSARIARNTQLFLQQESGTTRVIDPWSGSAYVEELTWDLARKAWGHIQEVEKVGGMAKAIEKGIPKMRIEEAAARTQARIDSGRQPLIGVNKYRLEHEPPLDVLKVDNSTVLAEQKAKLVKLRAERDPEKVKAALDKITWAAANPDDKDPDRNLLKLCIDAGRAMATVGEMSDALEKVFGRYTAQIRTISGVYSKEVKNTPEVEEARELVEEFEQAEGRRPRILLAKMGQDGHDRGQKVIATAYADLGFDVDVGPLFQTPEETARQAVEADVHVVGVSSLAGGHLTLVPALRKELDKLGRPDILITVGGVIPEQDFDELRKDGAVEIYTPGTVIPESAISLVKKLRASLDA

SEQ ID NO: 49 - protein, 148 aa, Propionibacterium freudenreichii
MSNEDLFICIDHVAYACPDADEASKYYQETFGWHELHREENPEQGVVEIMMAPAAKLTEHMTQVQVMAPLNDESTVAKWLAKHNGRAGLHHMAWRVDDIDAVSATLRERGVQLLYDEPKLGTGGNRINFMHPKSGKGVLIELTQYPKN

SEQ ID NO: 50 - protein, 524 aa, Artificial Sequence
  source: /note="Description of Artificial Sequence: Synthetic polypeptide"
MAENNNLKLASTMEGRVEQLAEQRQVIEAGGGERRVEKQHSQGKQTARERLNNLLDPHSFDEVGAFRKHRTTLFGMDKAVVPADGVVTGRGTILGRPVHAASQDFTVMGGSAGETQSTKVVETMEQALLTGTPFLFFYDSGGARIQEGIDSLSGYGKMFFANVKLSGVVPQIAIIAGPCAGGASYSPALTDFIIMTKKAHMFITGPQVIKSVTGEDVTADELGGAEAHMAISGNIHFVAEDDDAAELIAKKLLSFLPQNNTEEASFVNPNNDVSPNTELRDIVPIDGKKGYDVRDVIAKIVDWGDYLEVKAGYATNLVTAFARVNGRSVGIVANQPSVMSGCLDINASDKAAEFVNFCDSFNIPLVQLVDVPGFLPGVQQEYGGIIRHGAKMLYAYSEATVPKITVVLRKAYGGSYLAMCNRDLGADAVYAWPSAEIAVMGAEGAANVIFRKEIKAADDPDAMRAEKIEEYQNAFNTPYVAAARGQVDDVIDPADTRRKIASALEMYATKRQTRPAKKHGNFPC

SEQ ID NO: 51 - protein, 505 aa, Propionibacterium freudenreichii
MSPREIEVSEPREVGITELVLRDAHQSLMATRMAMEDMVGACADIDAAGYWSVECWGGATYDSCIRFLNEDPWERLRTFRKLMPNSRLQMLLRGQNLLGYRHYNDEVVDRFVDKSAENGMDVFRVFDAMNDPRNMAHAMAAVKKAGKHAQGTICYTISPVHTVEGYVKLAGQLLDMGADSIALKDMAALLKPQPAYDIIKAIKDTYGQKTQINLHCHSTTGVTEVSLMKAIEAGVDVVDTAISSMSLGPGHNPTESVAEMLEGTGYTTNLDYDRLHKIRDHFKAIRPKYKKFESKTLVDTSIFKSQIPGGMLSNMESQLRAQGAEDKMDEVMAEVPRVRKAAGFPPLVTPSSQIVGTQAVFNVMMGEYKRMTGEFADIMLGYYGASPADRDPKVVKLAEEQSGKKPITQRPADLLPPEWEEQSKEAAALKGFNGTDEDVLTYALFPQVAPVFFEHRAEGPHSVALTDAQLKAEAEGDEKSLAVAGPVTYNVNVGGTVREVTVQQA

SEQ ID NO: 52 - protein, 123 aa, Artificial Sequence
  source: /note="Description of Artificial Sequence: Synthetic polypeptide"
MKLKVTVNGTAYDVDVDVDKSHENPMGTILFGGGTGGAPAPRAAGGAGAGKAGEGEIPAPLAGTVSKILVKEGDTVKAGQTVLVLEAMKMETEINAPTDGKVEKVLVKERDAVQGGQGLIKIG

SEQ ID NO: 53 - DNA, 1137 bp, Artificial Sequence
  source: /note="Description of Artificial Sequence: Synthetic polynucleotide"
atggatttaaattctaaaaaatatcagatgcttaaagagctatatgtaagcttcgctgaaaatgaagttaaacctttagcaacagaacttgatgaagaagaaagatttccttatgaaacagtggaaaaaatggcaaaagcaggaatgatgggtataccatatccaaaagaatatggtggagaaggtggagacactgtaggatatataatggcagttgaagaattgtctagagtttgtggtactacaggagttatattatcagctcatacatctcttggctcatggcctatatatcaatatggtaatgaagaacaaaaacaaaaattcttaagaccactagcaagtggagaaaaattaggagcatttggtcttactgagcctaatgctggtacagatgcgtctggccaacaaacaactgctgttttagacggggatgaatacatacttaatggctcaaaaatatttataacaaacgcaatagctggtgacatatatgtagtaatggcaatgactgataaatctaaggggaacaaaggaatatcagcatttatagttgaaaaaggaactcctgggtttagctttggagttaaagaaaagaaaatgggtataagaggttcagctacgagtgaattaatatttgaggattgcagaatacctaaagaaaatttacttggaaaagaaggtcaaggatttaagatagcaatgtctactcttgatggtggtagaattggtatagctgcacaagctttaggtttagcacaaggtgctcttgatgaaactgttaaatatgtaaaagaaagagtacaatttggtagaccattatcaaaattccaaaatacacaattccaattagctgatatggaagttaaggtacaagcggctagacaccttgtatatcaagcagctataaataaagacttaggaaaaccttatggagtagaagcagcaatggcaaaattatttgcagctgaaacagctatggaagttactacaaaagctgtacaacttcatggaggatatggatacactcgtgactatccagtagaaagaatgatgagagatgctaagataactgaaatatatgaaggaactagtgaagttcaaagaatggttatttcaggaaaactattaaaatag

SEQ ID NO: 54 - DNA, 783 bp, Artificial Sequence
  source: /note="Description of Artificial Sequence: Synthetic polynucleotide"
atgaatatagtcgtttgtataaaacaagttccagatacaacagaagttaaactagatcctaatacaggtactttaattagagatggagtaccaagtataataaaccctgatgataaagcaggtttagaagaagctataaaattaaaagaagaaatgggtgctcatgtaactgttataacaatgggacctcctcaagcagatatggctttaaaagaagctttagcaatgggtgcagatagaggtatattattaacagatagagcatttgcgggtgctgatacttgggcaacttcatcagcattagcaggagcattaaaaaatatagattttgatattataatagctggaagacaggcgatagatggagatactgcacaagttggacctcaaatagctgaacatttaaatcttccatcaataacatatgctgaagaaataaaaactgaaggtgaatatgtattagtaaaaagacaatttgaagattgttgccatgacttaaaagttaaaatgccatgccttataacaactcttaaagatatgaacacaccaagatacatgaaagttggaagaatatatgatgctttcgaaaatgatgtagtagaaacatggactgtaaaagatatagaagttgacccttctaatttaggtcttaaaggttctccaactagtgtatttaaatcatttacaaaatcagttaaaccagctggtacaatatacaatgaagatgcgaaaacatcagctggaattatcatagataaattaaaagagaagtatatcatataa

SEQ ID NO: 55 - DNA, 1011 bp, Artificial Sequence
  source: /note="Description of Artificial Sequence: Synthetic polynucleotide"
atgggtaacgttttagtagtaatagaacaaagagaaaatgtaattcaaactgtttctttagaattactaggaaaggctacagaaatagcaaaagattatgatacaaaagtttctgcattacttttaggtagtaaggtagaaggtttaatagatacattagcacactatggtgcagatgaggtaatagtagtagatgatgaagctttagcagtgtatacaactgaaccatatacaaaagcagcttatgaagcaataaaagcagctgaccctatagttgtattatttggtgcaacttcaataggtagagatttagcgcctagagtttctgctagaatacatacaggtcttactgctgactgtacaggtcttgcagtagctgaagatacaaaattattattaatgacaagacctgcctttggtggaaatataatggcaacaatagtttgtaaagatttcagacctcaaatgtctacagttagaccaggggttatgaagaaaaatgaacctgatgaaactaaagaagctgtaattaaccgtttcaaggtagaatttaatgatgctgataaattagttcaagttgtacaagtaataaaagaagctaaaaaacaagttaaaatagaagatgctaagatattagtttctgctggacgtggaatgggtggaaaagaaaacttagacatactttatgaattagctgaaattataggtggagaagtttctggttctcgtgccactatagatgcaggttggttagataaagcaagacaagttggtcaaactggtaaaactgtaagaccagacctttatatagcatgtggtatatctggagcaatacaacatatagctggtatggaagatgctgagtttatagttgctataaataaaaatccagaagctccaatatttaaatatgctgatgttggtatagttggagatgttcataaagtgcttccagaacttatcagtcagttaagtgttgcaaaagaaaaaggtgaagttttagctaactaa

SEQ ID NO: 56 - DNA, 1176 bp, Artificial Sequence
  source: /note="Description of Artificial Sequence: Synthetic polynucleotide"
atgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatag

SEQ ID NO: 57 - DNA, 846 bp, Artificial Sequence
  source: /note="Description of Artificial Sequence: Synthetic polynucleotide"
atgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataa

SEQ ID NO: 58 - DNA, 798 bp, Artificial Sequence
  source: /note="Description of Artificial Sequence: Synthetic polynucleotide"
atgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaa

SEQ ID NO: 59 - DNA, 903 bp, Artificial Sequence
  source: /note="Description of Artificial Sequence: Synthetic polynucleotide"
atgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataa

SEQ ID NO: 60 - DNA, 1080 bp, Artificial Sequence
  source: /note="Description of Artificial Sequence: Synthetic polynucleotide"
atgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaa

SEQ ID NO: 61 - DNA, 1194 bp, Artificial Sequence
  source: /note="Description of Artificial Sequence: Synthetic polynucleotide"
atgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctga

SEQ ID NO: 62 - protein, 378 aa, Artificial Sequence
  source: /note="Description of Artificial Sequence: Synthetic polypeptide"
MDLNSKKYQMLKELYVSFAENEVKPLATELDEEERFPYETVEKMAKAGMMGIPYPKEYGGEGGDTVGYIMAVEELSRVCGTTGVILSAHTSLGSWPIYQYGNEEQKQKFLRPLASGEKLGAFGLTEPNAGTDASGQQTTAVLDGDEYILNGSKIFITNAIAGDIYVVMAMTDKSKGNKGISAFIVEKGTPGFSFGVKEKKMGIRGSATSELIFEDCRIPKENLLGKEGQGFKIAMSTLDGGRIGIAAQALGLAQGALDETVKYVKERVQFGRPLSKFQNTQFQLADMEVKVQAARHLVYQAAINKDLGKPYGVEAAMAKLFAAETAMEVTTKAVQLHGGYGYTRDYPVERMMRDAKITEIYEGTSEVQRMVISGKLLK

SEQ ID NO: 63 - protein, 260 aa, Artificial Sequence
  source: /note="Description of Artificial Sequence: Synthetic polypeptide"
MNIVVCIKQVPDTTEVKLDPNTGTLIRDGVPSIINPDDKAGLEEAIKLKEEMGAHVTVITMGPPQADMALKEALAMGADRGILLTDRAFAGADTWATSSALAGALKNIDFDIIIAGRQAIDGDTAQVGPQIAEHLNLPSITYAEEIKTEGEYVLVKRQFEDCCHDLKVKMPCLITTLKDMNTPRYMKVGRIYDAFENDVVETWTVKDIEVDPSNLGLKGSPTSVFKSFTKSVKPAGTIYNEDAKTSAGIIIDKLKEKYII

SEQ ID NO: 64 - protein, 336 aa, Artificial Sequence
  source: /note="Description of Artificial Sequence: Synthetic polypeptide"
MGNVLVVIEQRENVIQTVSLELLGKATEIAKDYDTKVSALLLGSKVEGLIDTLAHYGADEVIVVDDEALAVYTTEPYTKAAYEAIKAADPIVVLFGATSIGRDLAPRVSARIHTGLTADCTGLAVAEDTKLLLMTRPAFGGNIMATIVCKDFRPQMSTVRPGVMKKNEPDETKEAVINRFKVEFNDADKLVQVVQVIKEAKKQVKIEDAKILVSAGRGMGGKENLDILYELAEIIGGEVSGSRATIDAGWLDKARQVGQTGKTVRPDLYIACGISGAIQHIAGMEDAEFIVAINKNPEAPIFKYADVGIVGDVHKVLPELISQLSVAKEKGEVLAN

SEQ ID NO: 65 - protein, 397 aa, Artificial Sequence
  source: /note="Description of Artificial Sequence: Synthetic polypeptide"
MIVKPMVRNNICLNAHPQGCKKGVEDQIEYTKKRITAEVKAGAKAPKNVLVLGCSNGYGLASRITAAFGYGAATIGVSFEKAGSETKYGTPGWYNNLAFDEAAKREGLYSVTIDGDAFSDEIKAQVIEEAKKKGIKFDLIVYSLASPVRTDPDTGIMHKSVLKPFGKTFTGKTVDPFTGELKEISAEPANDEEAAATVKVMGGEDWERWIKQLSKEGLLEEGCITLAYSYIGPEATQALYRKGTIGKAKEHLEATAHRLNKENPSIRAFVSVNKGLVTRASAVIPVIPLYLASLFKVMKEKGNHEGCIEQITRLYAERLYRKDGTIPVDEENRIRIDDWELEEDVQKAVSALMEKVTGENAESLTDLAGYRHDFLASNGFDVEGINYEAEVERFDRI

SEQ ID NO: 66 - protein, 391 aa, Artificial Sequence
  source: /note="Description of Artificial Sequence: Synthetic polypeptide"
MREVVIASAARTAVGSFGGAFKSVSAVELGVTAAKEAIKRANITPDMIDESLLGGVLTAGLGQNIARQIALGAGIPVEKPAMTINIVCGSGLRSVSMASQLIALGDADIMLVGGAENMSMSPYLVPSARYGARMGDAAFVDSMIKDGLSDIFNNYHMGITAENIAEQWNITREEQDELALASQNKAEKAQAEGKFDEEIVPVVIKGRKGDTVVDKDEYIKPGTTMEKLAKLRPAFKKDGTVTAGNASGINDGAAMLVVMAKEKAEELGIEPLATIVSYGTAGVDPKIMGYGPVPATKKALEAANMTIEDIDLVEANEAFAAQSVAVIRDLNIDMNKVNVNGGAIAIGHPIGCSGARILTTLLYEMKRRDAKTGLATLCIGGGMGTTLIVKR

SEQ ID NO: 67 - protein, 281 aa, Artificial Sequence
  source: /note="Description of Artificial Sequence: Synthetic polypeptide"
MKLAVIGSGTMGSGIVQTFASCGHDVCLKSRTQGAIDKCLALLDKNLTKLVTKGKMDEATKAEILSHVSSTTNYEDLKDMDLIIEASVEDMNIKKDVFKLLDELCKEDTILATNTSSLSITEIASSTKRPDKVIGMHFFNPVPMMKLVEVISGQLTSKVTFDTVFELSKSINKVPVDVSESPGFVVNRILIPMINEAVGIYADGVASKEEIDEAMKLGANHPMGPLALGDLIGLDVVLAIMNVLYTEFGDTKYRPHPLLAKMVRANQLGRKTKIGFYDYNK

SEQ ID NO: 68 - protein, 265 aa, Artificial Sequence
  source: /note="Description of Artificial Sequence: Synthetic polypeptide"
MSTSDVKVYENVAVEVDGNICTVKMNRPKALNAINSKTLEELYEVFVDINNDETIDVVILTGEGKAFVAGADIAYMKDLDAVAAKDFSILGAKAFGEIENSKKVVIAAVNGFALGGGCELAMACDIRIASAKAKFGQPEVTLGITPGYGGTQRLTRLVGMAKAKELIFTGQVIKADEAEKIGLVNRVVEPDILIEEVEKLAKIIAKNAQLAVRYSKEAIQLGAQTDINTGIDIESNLFGLCFSTKDQKEGMSAFVEKREANFIKG

SEQ ID NO: 69 - protein, 300 aa, Artificial Sequence
  source: /note="Description of Artificial Sequence: Synthetic polypeptide"
MRSFEEVIKFAKERGPKTISVACCQDKEVLMAVEMARKEKIANAILVGDIEKTKEIAKSIDMDIENYELIDIKDLAEASLKSVELVSQGKADMVMKGLVDTSIILKAVLNKEVGLRTGNVLSHVAVFDVEGYDRLFFVTDAAMNLAPDTNTKKQIIENACTVAHSLDISEPKVAAICAKEKVNPKMKDTVEAKELEEMYERGEIKGCMVGGPFAIDNAVSLEAAKHKGINHPVAGRADILLAPDIEGGNILYKALVFFSKSKNAGVIVGAKAPIILTSRADSEETKLNSIALGVLMAAKA

SEQ ID NO: 70 - protein, 359 aa, Artificial Sequence
  source: /note="Description of Artificial Sequence: Synthetic polypeptide"
MSKIFKILTINPGSTSTKIAVFDNEDLVFEKTLRHSSEEIGKYEKVSDQFEFRKQVIEEALKEGGVKTSELDAVVGRGGLLKPIKGGTYSVSAAMIEDLKVGVLGEHASNLGGIIAKQIGEEVNVPSYIVDPVVVDELEDVARISGMPEISRASVVHALNQKAIARRYAREINKKYEDINLIVAHMGGGVSVGAHKNGKIVDVANALDGEGPFSPERSGGLPVGALVKMCFSGKYTQDEIKKKIKGNGGLVAYLNTNDAREVEERIEAGDEKAKLVYEAMAYQISKEIGASAAVLKGDVKAILLTGGIAYSKMFTEMIADRVKFIADVKVYPGEDEMIALAQGGLRVLTGEEEAQVYDN

SEQ ID NO: 71 - DNA, 114 bp, Artificial Sequence
  source: /note="Description of Artificial Sequence: Synthetic polynucleotide"
atggacgagttcgaacgccacgcggagggaactttcacttctgatgtttctagctatttggagggccaggctgcgaaagagtttattgcttggctggttaaaggtcgtggttaa

SEQ ID NO: 72 - DNA, 111 bp, Artificial Sequence
  source: /note="Description of Artificial Sequence: Synthetic polynucleotide"
gacgagttcgaacgccacgcggagggaactttcacttctgatgtttctagctatttggagggccaggctgcgaaagagtttattgcttggctggttaaaggtcgtggttaa

SEQ ID NO: 73 - protein, 37 aa, Artificial Sequence
  source: /note="Description of Artificial Sequence: Synthetic polypeptide"
HDEFERHAEGTFTSDVSSYLEGQAAKEFIAWLVKGRG

SEQ ID NO: 74 - protein, 37 aa, Artificial Sequence
  source: /note="Description of Artificial Sequence: Synthetic polypeptide"
MDEFERHAEGTFTSDVSSYLEGQAAKEFIAWLVKGRG

SEQ ID NO: 75 - protein, 31 aa, Artificial Sequence
  source: /note="Description of Artificial Sequence: Synthetic polypeptide"
HAEGTFTSDVSSYLEGQAAKEFIAWLVKGRG

SEQ ID NO: 76 - protein, 30 aa, Artificial Sequence
  source: /note="Description of Artificial Sequence: Synthetic polypeptide"
HAEGTFTSDVSSYLEGQAAKEFIAWLVKGR

SEQ ID NO: 77 - protein, 180 aa, Homo sapiens
MKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 78 - protein, 160 aa, Artificial Sequence
  source: /note="Description of Artificial Sequence: Synthetic polypeptide"
RSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 79 - protein, 29 aa, Artificial Sequence
  source: /note="Description of Artificial Sequence: Synthetic peptide"
HSQGTFTSDYSKYLDSRRAQDFVQWLMNT

SEQ ID NO: 80 - protein, 69 aa, Artificial Sequence
  source: /note="Description of Artificial Sequence: Synthetic polypeptide"
RSLQDTEEKSRSFSASQADPLSDPDQMNEDKRHSQGTFTSDYSKYLDSRRAQDFVQWLMNTKRNRNNIA

SEQ ID NO: 81 - protein, 30 aa, Artificial Sequence
  source: /note="Description of Artificial Sequence: Synthetic polypeptide"
RSLQDTEEKSRSFSASQADPLSDPDQMNED

SEQ ID NO: 82 - protein, 37 aa, Artificial Sequence
  source: /note="Description of Artificial Sequence: Synthetic polypeptide"
HSQGTFTSDYSKYLDSRRAQDFVQWLMNTKRNRNNIA

SEQ ID NO: 83 - protein, 39 aa, Artificial Sequence
  source: /note="Description of Artificial Sequence: Synthetic polypeptide"
HGEGTFTSDLSKQMEEEAVRLFIEWLKNGGPSSGAPPPS

SEQ ID NO: 84 - protein, 33 aa, Artificial Sequence
  source: /note="Description of Artificial Sequence: Synthetic polypeptide"
HAEGTFTSDVSSYLEGQAAKEEFIIAWLVKGRG

SEQ ID NO: 85 - protein, 44 aa, Artificial Sequence
  source: /note="Description of Artificial Sequence: Synthetic polypeptide"
HGEGTFTSDLSKQMEEEAVRLFIEWLKNGGPSSGAPPSKKKKKK

SEQ ID NO: 86 - protein, 645 aa, Artificial Sequence
  source: /note="Description of Artificial Sequence: Synthetic polypeptide"
HGEGTFTSDVSSYLEGQAAKEFIAWLVKGRHGEGTFTSDVSSYLEGQAAKEFIAWLVKGRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 87 - protein, 275 aa, Artificial Sequence
  source: /note="Description of Artificial Sequence: Synthetic polypeptide"
HGEGTFTSDVSSYLEEQAAKEFIAWLVKGGGGGGGSGGGGSGGGGSAESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 88 - protein, 32 aa, Artificial Sequence
  source: /note="Description of Artificial Sequence: Synthetic polypeptide"
  MOD_RES (2)..(2): Aib
  MOD_RES (31)..(31): Aib
  MISC_FEATURE (32)..(32): /note="C-term NH2"
HXEGTFTSDVSSYLEGQAAKEFLLEAWLVKXR

SEQ ID NO: 89 - protein, 463 aa, Artificial Sequence
  source: /note="Description of Artificial Sequence: Synthetic polypeptide"
MAGAPGPLRLALLLLGMVGRAGPRPQGATVSLWETVQKWREYRRQCQRSLTEDPPPATDLFCNRTFDEYACWPDGEPGSFVNVSCPWYLPWASSVPQGHVYRFCTAEGLWLQKDNSSLPWRDLSECEESKRGERSSPEEQLLFLYIIYTVGYALSFSALVIASAILLGFRHLHCTRNYIHLNLFASFILRALSVFIKDAALKWMYSTAAQQHQWDGLLSYQDSLSCRLVFLLMQYCVAANYYWLLVEGVYLYTLLAFSVLSEQWIFRLYVSIGWGVPLLFVVPWGIVKYLYEDEGCWTRNSNMNYWLIIRLPILFAIGVNFLIFVRVICIVVSKLKANLMCKTDIKCRLAKSTLTLIPLLGTHEVIFAFVMDEHARGTLRFIKLFTELSFTSFQGLMVAILYCFVNNEVQLEFRKSWERWRLEHLHIQRDSSMKPLKCPTSSLSSGATAGSSMYTATCQASCS

SEQ ID NO: 90 - DNA, 975 bp, Lactobacillus plantarum
atgtgtactgccataacttatcaatcttataataattacttcggtagaaatttcgattatgaaatttcatacaatgaaatggttacgattacgcctagaaaatatccactagtatttcgtaaggtggagaacttagatcaccattatgcaataattggaattactgctgatgtagaaagctatccactttactacgatgcgatgaatgaaaaaggcttgtgtattgcgggattaaattttgcaggttatgctgattataaaaaatatgatgctgataaagttaatatcacaccatttgaattaattccttggttattgggacaattttcaagtgttagagaagtgaaaaagaacatacaaaaactaaacttggttaatattaattttagtgaacaattaccattatcaccgctacattggttggttgctgataaacaggaatcgatagttattgaaagtgtcaaagaaggactaaaaatttacgacaatccagtaggtgtgttaacaaacaatcctaattttgactaccaattatttaatttgaacaactatcgtgccttatcaaatagcacaccccaaaatagtttttcggaaaaagtggatttagatagttatagtagaggaatgggcggactaggattacctggagacttgtcctcaatgtctagatttgtcagagccgcttttactaaattaaactcgttgtcgatgcagacagagagtggcagtgttagtcagtttttccatatactagggtctgtagaacaacaaaaagggctatgtgaagttactgacggaaagtacgaatatacaatctattcttcttgttgtgatatggacaaaggagtttattactatagaacttatgacaatagtcaaattaacagtgtcagtttaaaccatgagcacttggatacgactgaattaatttcttatccattacgatcagaagcacaatactatgcagttaactaa

SEQ ID NO: 91 - protein, 324 aa, Lactobacillus plantarum
MCTAITYQSYNNYFGRNFDYEISYNEMVTITPRKYPLVFRKVENLDHHYAIIGITADVESYPLYYDAMNEKGLCIAGLNFAGYADYKKYDADKVNITPFELIPWLLGQFSSVREVKKNIQKLNLVNINFSEQLPLSPLHWLVADKQESIVIESVKEGLKIYDNPVGVLTNNPNFDYQLFNLNNYRALSNSTPQNSFSEKVDLDSYSRGMGGLGLPGDLSSMSRFVRAAFTKLNSLSMQTESGSVSQFFHILGSVEQQKGLCEVTDGKYEYTIYSSCCDMDKGVYYYRTYDNSQINSVSLNHEHLDTTELISYPLRSEAQYYAVN

SEQ ID NO: 92 - DNA, 951 bp, Methanobrevibacter smithii
atgtgtactgctgcaaattatttaacaaaatgccattattttggccgtaattttgactatgaaatttcatataatgaaagagtaacgataactcctagaaactatcctttaatattcagggatactgaggacattgaaaatcattatgggattattggcatagctgcaggtattgatgaatatcctttgtattatgatgcatgtaatgagaaaggattagctatggggggattaaactttccggattactgtgactacaaaccactagataaatctaaagttaacatagcttcttttgagattattccatatatattatctcaagcaaaaaccatcagtgatgccgaaaggttattggaaaacttaaatatttcagatgagaaattttccgcccagttgcctccatctccacttcattggattatttcagataggaatgcttcaattgttgtagaggttgtagaggaaggactggatatttatgataatcctgtaggagttttaacaaacaaccctccttttgataaacagctatttaatttaaataattatatggcattatcaaacagaacgcctgaaaatacctttggaggcaatttggatttggcaacttatagtcggggaatgggttcaattggtcttccgggggatgtttcttcacagtcccgttttgtaaaagcagcttttgttaaagaaaattccgtttccggagattctgaaaaagaaagtgtgtctcagtttttccatattctggcatctgttgaacagcaaaaaggatgtacgttagtggaagaacctgataaatttgagtatactatttattcagactgttacaatacagataagggaatattgtattataaaacatatgatggtcctcaaacatctgttaatatacatgatgaggatttggaaaccaatcagttaattaattttgagttggttgattaa

SEQ ID NO: 93 - protein, 316 aa, Methanobrevibacter smithii
MCTAANYLTKCHYFGRNFDYEISYNERVTITPRNYPLIFRDTEDIENHYGIIGIAAGIDEYPLYYDACNEKGLAMGGLNFPDYCDYKPLDKSKVNIASFEIIPYILSQAKTISDAERLLENLNISDEKFSAQLPPSPLHWIISDRNASIVVEVVEEGLDIYDNPVGVLTNNPPFDKQLFNLNNYMALSNRTPENTFGGNLDLATYSRGMGSIGLPGDVSSQSRFVKAAFVKENSVSGDSEKESVSQFFHILASVEQQKGCTLVEEPDKFEYTIYSDCYNTDKGILYYKTYDGPQTSVNIHDEDLETNQLINFELVD

SEQ ID NO: 94 - DNA, 1080 bp, Bacteroides vulgatus
atggttatgaaaaagattttgatagctttggccttattgctgacaggcattgcaagcggatcggcatgtaccggtatttcattcctcgctgaagatggcggatatgtgcaggcacgtactatagagtgggggaacagttatcttccgagtgaatatgttattgttcccagaggacaggatttggtatcttatactccaacgggtgtaaatggcttgagatttcgggctaaatatggtctggtaggactggctatcattcagaaagagtttgtggctgaaggactgaatgaagtagggctttcggctggattgttttattttccccattatgggaagtatgaagaatatgatgaggctcaaaatgcaattactttgtcggatttgcaggtggtgaactggatgctttcccaatttgctactatagacgaagtgagagaagctatagaaggggtgaaggtggtgtctcttgataaacctggtaaaagttctacggtacattggcgcattggcgatgctaaaggaaatcaaatggtgttggaatttgtaggtggtgttccttatttttatgaaaataaagtaggagtactcaccaattctcccgattttccatggcaggtgattaacttgaataattatgtaaatctatatccgggagctgtcactccacagcaatggggtggggtgactattttcccttttggcgcaggtgccggatttcatggtattccgggggatgtaactcctccatcccgttttgttcgtgtagcgttttataaggcaacagctccggtgtgtcctacagcgtatgacgctatattacaaagctttcatatcctgaataattttgatattcctattggtatagaatatgcgttagggaaagcacctgatattcctagtgccacacaatggacttcggctattgatttgacaaacaggaaagtgtattataaaacagcatacaataacaatattcgttgtattagtatgaagaagattgattttgataaagtgaagtatcagtcgtatccattggataaggagttgaaacagcctgtagaagagattattgtgaaatag

SEQ ID NO: 95 - protein, 359 aa, Bacteroides vulgatus
MVMKKILIALALLLTGIASGSACTGISFLAEDGGYVQARTIEWGNSYLPSEYVIVPRGQDLVSYTPTGVNGLRFRAKYGLVGLAIIQKEFVAEGLNEVGLSAGLFYFPHYGKYEEYDEAQNAITLSDLQVVNWMLSQFATIDEVREAIEGVKVVSLDKPGKSSTVHWRIGDAKGNQMVLEFVGGVPYFYENKVGVLTNSPDFPWQVINLNNYVNLYPGAVTPQQWGGVTIFPFGAGAGFHGIPGDVTPPSRFVRVAFYKATAPVCPTAYDAILQSFHILNNFDIPIGIEYALGKAPDIPSATQWTSAIDLTNRKVYYKTAYNNNIRCISMKKIDFDKVKYQSYPLDKELKQPVEEIIVK

SEQ ID NO: 96 - DNA, 954 bp, Bifidobacterium longum
atgtgcactggtgtccgtttctccgatgatgagggcaacacctatttcggccgtaatctcgactggagtttctcatatggggagaccatcctggttactccgcgcggctaccactatgacacggtgtttggtgcgggcggcaaggcgaagccgaacgcggtgatcggcgtgggtgtggtcatggccgataggccgatgtatttcgactgcgccaatgaacatggtctggccatcgccggcttgaatttccccggctacgcctcgttcgtccacgaaccggtcgaaggcacggaaaacgtcgccacgttcgaatttccgctgtgggtggcgcgtaatttcgactccgtcgacgaggtcgaggaggcgctcaggaacgtgacgctcgtctcccagatcgtgccgggacagcaggagtctctgctgcactggttcatcggcgacggcaagcgcagcatcgtcgtcgagcagatggccgatggcatgcacgtgcatcatgatgacgtcgatgtgctgaccaatcagccgacgttcgacttccatatggaaaacctgcgcaactacatgtgcgtcagcaacgagatggccgaaccgacttcatggggcaaggcctccttgaccgcctggggtgcgggtgtgggcatgcatggcatcccgggcgacgtgagttccccgtcgcgcttcgttcgtgtggcctacaccaacgcgcattacccgcagcagaacgatgaagccgccaatgtgtcgcgcctgttccacaccctcggctccgtgcagatggtggacggcatggcgaagatgggcgacggccagttcgaacgcacgctgttcaccagcggatattcgtccaagaccaacacctattacatgaacacctatgatgaccccgccatccgttcctacgccatggccgattacgatatggattcctcggagctcatcagcgtcgcccgatga

SEQ ID NO: 97 - protein, 317 aa, Bifidobacterium longum
MCTGVRFSDDEGNTYFGRNLDWSFSYGETILVTPRGYHYDTVFGAGGKAKPNAVIGVGVVMADRPMYFDCANEHGLAIAGLNFPGYASFVHEPVEGTENVATFEFPLWVARNFDSVDEVEEALRNVTLVSQIVPGQQESLLHWFIGDGKRSIVVEQMADGMHVHHDDVDVLTNQPTFDFHMENLRNYMCVSNEMAEPTSWGKASLTAWGAGVGMHGIPGDVSSPSRFVRVAYTNAHYPQQNDEAANVSRLFHTLGSVQMVDGMAKMGDGQFERTLFTSGYSSKTNTYYMNTYDDPAIRSYAMADYDMDSSELISVAR

SEQ ID NO: 98 - DNA, 978 bp, Listeria monocytogenes
atgtgtacgtcaataacttatacaacgaaggatcactattttggaaggaatttcgattatgaactttcttacaaagaagttgtggttgttacgccgaaaaattacccgttccattttcgcaaggtagaggatatagagaagcattatgcacttattggtattgctgctgtgatggaaaactacccgttgtattacgatgctaccaatgaaaaaggccttagtatggcaggactcaatttctcaggaaatgcggattacaaggattttgcagaaggtaaggacaatgtgaccccctttgaatttattccgtggattcttggtcaatgcgctactgtaaaagaagcaagaagattacttcagagaatcaatctcgtgaatattagttttagtgaaaatttaccgctgtctccattacattggttgatggctgatcaaacagaatctattgtagtggaatgtgtgaaagatggacttcacatttatgataatcctgttggcgtgttaacaaataatccaacatttgattaccaactatttaatttaaacaattatcgcgttctttcgagtgaaaccccagaaaataatttttccaaagagattgatttggatgcttatagtcgtgggatgggcggaattggcttacctggtgatttatcttctatgtctcgttttgtgaaagcaacttttaccaaattgaattctgtttcaggtgattctgaatcagaaagtattagccaatttttccatattttaggctcggtggaacaacaaaaaggtctttgtgatgttggtgggggaaaatacgagcatactatttattcctcgtgttgcaatatcgataaaggaatttattattatagaacatacggaaacagtcaaattactggtgtggatatgcaccaagaggatttagagagcaaagaactagctatttatccactcgtcaatgagcaacgactaaacattgttaacaaataa

SEQ ID NO: 99 - protein, 325 aa, Listeria monocytogenes
MCTSITYTTKDHYFGRNFDYELSYKEVVVVTPKNYPFHFRKVEDIEKHYALIGIAAVMENYPLYYDATNEKGLSMAGLNFSGNADYKDFAEGKDNVTPFEFIPWILGQCATVKEARRLLQRINLVNISFSENLPLSPLHWLMADQTESIVVECVKDGLHIYDNPVGVLTNNPTFDYQLFNLNNYRVLSSETPENNFSKEIDLDAYSRGMGGIGLPGDLSSMSRFVKATFTKLNSVSGDSESESISQFFHILGSVEQQKGLCDVGGGKYEHTIYSSCCNIDKGIYYYRTYGNSQITGVDMHQEDLESKELAIYPLVNEQRLNIVNK

SEQ ID NO: 100 - DNA, 990 bp, Clostridium perfringens
atgtgtacaggattagccttagaaacaaaagatggattacatttgtttggaagaaatatggatattgaatattcatttaatcaatctattatatttattcctaggaattttaaatgtgtaaacaaatcaaacaaaaaagaattaacaacaaaatatgctgttcttggaatgggaactatttttgatgattatcctacctttgcagatggtatgaatgaaaagggattagggtgtgctggcttaaatttccctgtttatgttagctattctaaagaagatatagaaggtaaaactaatattccagtatataatttcttattatgggttttagctaattttagctcagtagaagaggtaaaggaagcattaaaaaatgctaatatagtggatatacctattagcgaaaatattcctaatacaactcttcattggatgataagcgatataacaggaaagtctattgtggttgaacaaacaaaggaaaaattaaatgtatttgataataatattggagtattaactaattcacctacttttgattggcatgtagcaaatttaaatcaatatgtaggtttgagatataatcaagttccagaatttaagttaggagatcaatctttaactgctttaggtcaaggaactggtttagtaggattaccaggggactttacacctgcatctagatttataagagtagcatttttaagagatgcaatgataaaaaatgataaagattcaatagacttaattgaatttttccatatattaaataatgttgctatggtaagaggatcaactagaactgtagaagaaaaaagtgatcttactcaatatacaagttgcatgtgtttagaaaaaggaatttattattataatacctatgaaaataatcaaattaatgcaatagacatgaataaagaaaacttagatggaaatgaaattaaaacatataaatacaacaaaactttaagtattaatcatgtaaattag

SEQ ID NO: 101 - protein, 329 aa, Clostridium perfringens
MCTGLALETKDGLHLFGRNMDIEYSFNQSIIFIPRNFKCVNKSNKKELTTKYAVLGMGTIFDDYPTFADGMNEKGLGCAGLNFPVYVSYSKEDIEGKTNIPVYNFLLWVLANFSSVEEVKEALKNANIVDIPISENIPNTTLHWMISDITGKSIVVEQTKEKLNVFDNNIGVLTNSPTFDWHVANLNQYVGLRYNQVPEFKLGDQSLTALGQGTGLVGLPGDFTPASRFIRVAFLRDAMIKNDKDSIDLIEFFHILNNVAMVRGSTRTVEEKSDLTQYTSCMCLEKGIYYYNTYENNQINAIDMNKENLDGNEIKTYKYNKTLSINHVN

SEQ ID NO: 102 - DNA, 975 bp, Enterococcus faecium
atgtgtacgtctattacttatgtaacaagtgatcattattttggaaggaattttgattatgaaatatcttacaatgaagtagttactgttactccaagaaattataagttgaattttcgaaaggtaaatgatttggatactcattatgcaatgattggtattgccgctggtatagctgactaccctctttattacgatgcgacaaatgaaaaaggattgagtatggctgggctaaatttttctgggtatgctgattataaagaaatacaagaagggaaagacaatgtatctccttttgaatttattccttggattttaggacaatgctcaacagtaggagaagctaaaaaattgttaaaaaatatcaatttagcaaatataaattatagtgacgaacttcctttatcccctttacattggctattagctgataaagaaaaatcaattgtcattgaaagtatgaaagatggacttcatatatatgataaccctgtgggcgttcttaccaataatccttcatttgactatcaattatttaatttaaacaattatcgtgtcttatcgagtgaaactcctaaaaataatttttcaaatcaaataagtttgaatgcctatagccgcggtatgggagggataggcttgcctggagatttatcctcagtatctcgttttgttaaagcgacttttacgaagctgaattctgtatctggagattcagagtcagaaagtattagtcaatttttccatatcttaggttcagtagaacaacaaaaaggtttgtgtgatgtaggtgatggaaaatatgaatatacaatttattcttcttgttgcaatgttgacaaaggaatctattattatcgaacatatgaagacagtcaaattactgcaattgatatgaataaagaagacttagatagtcataagttaattagttatccaattatagaaaaacaacaaattaaatatataaattag

SEQ ID NO: 103 - protein, 324 aa, Enterococcus faecium
MCTSITYVTSDHYFGRNFDYEISYNEVVTVTPRNYKLNFRKVNDLDTHYAMIGIAAGIADYPLYYDATNEKGLSMAGLNFSGYADYKEIQEGKDNVSPFEFIPWILGQCSTVGEAKKLLKNINLANINYSDELPLSPLHWLLADKEKSIVIESMKDGLHIYDNPVGVLTNNPSFDYQLFNLNNYRVLSSETPKNNFSNQISLNAYSRGMGGIGLPGDLSSVSRFVKATFTKLNSVSGDSESESISQFFHILGSVEQQKGLCDVGDGKYEYTIYSSCCNVDKGIYYYRTYEDSQITAIDMNKEDLDSHKLISYPIIEKQQIKYIN

SEQ ID NO: 104 - DNA, 989 bp, Lacotbacillus acidophilus
aagagaaaaatatgtgtacatcaattatattcagtcccaaagatcattactttggtcgtaaccttgatttagaaattacttttggtcaacaagttgttattacgccacgcaattacacttttaaattccgtaagatgcccagtttaaaaaagcactatgcaatgattggtatctcattagatatggatgattatcccctatatttcgacgctacaaatgaaaaaggtttaggtatggccggactcaactatccaggaaatgctacatattatgaagaaaaagaaaataaagataatattgcttcctttgaattcatcccttggattttaggacagtgtagcactattagcgaagtaaaggatttacttagcagaatcaacatcgccgatttaaatttcagcgaaaaaatgcaagcctcctctcttcactggcttattgcagataaaacaggtacatcattagttgttgaaacagacaaagatggaatgcatatttatgataatccagttggctgcttaactaataatccacaatttccaaagcaattattcaatttaaataactatgctgacgtatctccaaaaatgcctaaaaataacttctcagataaagtaaatatggctggctacagccgtggattagggtctcacaacttaccaggtggaatggattctgaatcacgttttgtcagagtagctttcaataaatttaatgctccaattgctgaaaccgaagaagaaaatattgatacttacttccacattttacattcggttgaacaacaaaagggactggatgaagttggtccaaactcatttgaatatacaatttattctgatggaactaacttagacaaaggtattttctactacaccacttattcaaacaaacaaattaacgttgttgatatgaataaagaagatctagatagcagcaatttgatcacttatgatatgcttgataaaactaaatttaaccatcaaaactaa

SEQ ID NO: 105 - protein, 325 aa, Lacotbacillus acidophilus
MCTSIIFSPKDHYFGRNLDLEITFGQQVVITPRNYTFKFRKMPSLKKHYAMIGISLDMDDYPLYFDATNEKGLGMAGLNYPGNATYYEEKENKDNIASFEFIPWILGQCSTISEVKDLLSRINIADLNFSEKMQASSLHWLIADKTGTSLVVETDKDGMHIYDNPVGCLTNNPQFPKQLFNLNNYADVSPKMPKNNFSDKVNMAGYSRGLGSHNLPGGMDSESRFVRVAFNKFNAPIAETEEENIDTYFHILHSVEQQKGLDEVGPNSFEYTIYSDGTNLDKGIFYYTTYSNKQINVVDMNKEDLDSSNLITYDMLDKTKFNHQN

SEQ ID NO: 106 - DNA, 994 bp, Lacotbacillus acidophilus
agaaagcgtgcagtaaatgtgtacatcaatttgttataatcctaacgatcattattttggtagaaatcttgactatgaaattgcttatggtcaaaaagtagtcattgtaccaagaaactacgaatttaagtatagagaaatgccctctcaaaagatgcattatgcttttatcggagtatctgtagttaatgatgattatccattattatgtgatgcaattaatgaaaaggggcttggtattgcaggattaaattttcaaggtcctaatcattactttcctaaaatcgaaggtaagaagaatattgcttcttttgaattaatgccatacttattaagtaattgtgaaaatactgacgatgttaaagaaatcttagataatgcaaatattttaaatattagcttttcagcaaattatcctgcagctgatttacattggattttaagtgataaagctggtaagagtatcgtagttgaatcaaccaattcaggtttacatatttatgataatccagtgaatgtcttaactaacaatcctgaatttccggatcaattaattaaattaagtgactacgccgacgttactccacataatcctaagaatacattggttcctaatgttgatcttaatctatatagtagaggcttaggtactcaccacttacctggtggaatggattctagctctcgatttgttaaggtagcttttgtcttggcacacactccacaaggaaaaaatgaagtggaaaatgttactaattatttccatattctgcattcagtagaacaacctgatggtttagatgaagtagaagataatcgctatgaatatactatgtatacagattgtatgaacttagataaaggtattttgtactttactacttatgacaataatcggattaatgcagtagatatgcataaagcagatttagattcagaagatttaatctgctacgatttgtttaagaaacaagatattgaatatatgaattaa

SEQ ID NO: 107 - protein, 325 aa, Lacotbacillus acidophilus
MCTSICYNPNDHYFGRNLDYEIAYGQKVVIVPRNYEFKYREMPSQKMHYAFIGVSVVNDDYPLLCDAINEKGLGIAGLNFQGPNHYFPKIEGKKNIASFELMPYLLSNCENTDDVKEILDNANILNISFSANYPAADLHWILSDKAGKSIVVESTNSGLHIYDNPVNVLTNNPEFPDQLIKLSDYADVTPHNPKNTLVPNVDLNLYSRGLGTHHLPGGMDSSSRFVKVAFVLAHTPQGKNEVENVTNYFHILHSVEQPDGLDEVEDNRYEYTMYTDCMNLDKGILYFTTYDNNRINAVDMHKADLDSEDLICYDLFKKQDIEYMN

SEQ ID NO: 108 - DNA, 1104 bp, Brucella abortus
atggaaacgaaaagctctctctggaaatcatcgcgccgcgtgcttgcacatggggctgcaactgttctggtcgcggcgggccttatcgttccccaggcggctatggcttgcacgagcttcgttctgccgacgagcgacggtggtatggtctatggtcgcacgatggaattcgggttcaatctcaaatccgacatgattgccattccgcgcaattacaccatcacggcaagcgggccggacggtgctgcgggcaagaaatggaagggcaaatatgccacgatcggcatgaatgcttttggtatcgtcgctctcaccgacggtatgaacgagaaggggcttgcaggcgggcttctctatttcccggaatatgccaagtatcaggacccatccacggcgaagccggaagacagcctcgctccgtgggatttcctgacctgggcgctggccaatttttcgacagtggccgaagtcaaggatgctttgagcaccatttccatcgtcgatgtgaaacaaaaggacctgggatttaccccgcccgctcactacacgctgcatgatgcgaccggcgcatccatcgtgatcgaaccgatcgacggcaagctcaaggtttacgacaacaagctcggtgtcatgaccaattcgccgtctttcgactggcacatgaccaatctgcgcaactatgtctatctctcgcgtgaaaatccgaagccgttgcagatccttggcgagacgatccagtcattcgggcaaggcgccggtatgcatggtattccgggcgacaccacgccgccatcgcgtttcgtgcgtgcaagcgcctacgtcctttccgccaagaaggtgccgagcggccttgaaagcgtgcggctggccgagcatattgccaataacttcgacattccaaagggatggagcgaagagcagaatatgtttgaatatacccagtggaccgcctttgcggacatgaagaacgatgtctattacatcaagacctatgacgatcaggttctgcgcagcttcagcttcaaggattttgatgtcgatagcaaagatattctaacgatcaagttcgagccaaaactggacgcgccgtcactgaaaaagtaa

SEQ ID NO: 109 - protein, 367 aa, Brucella abortus
METKSSLWKSSRRVLAHGAATVLVAAGLIVPQAAMACTSFVLPTSDGGMVYGRTMEFGFNLKSDMIAIPRNYTITASGPDGAAGKKWKGKYATIGMNAFGIVALTDGMNEKGLAGGLLYFPEYAKYQDPSTAKPEDSLAPWDFLTWALANFSTVAEVKDALSTISIVDVKQKDLGFTPPAHYTLHDATGASIVIEPIDGKLKVYDNKLGVMTNSPSFDWHMTNLRNYVYLSRENPKPLQILGETIQSFGQGAGMHGIPGDTTPPSRFVRASAYVLSAKKVPSGLESVRLAEHIANNFDIPKGWSEEQNMFEYTQWTAFADMKNDVYYIKTYDDQVLRSFSFKDFDVDSKDILTIKFEPKLDAPSLKK

SEQ ID NO: 110 - DNA, 1323 bp, Lactobacillus johnsonii
atgtcgaccacaccgacacagccatcatcacgaaaacaggctgtttacccgtacttgatcgtgctgtcgggcatcgtcttcacggccatcccggtatcgctggtctgcagttgcgcaggtatcttcttcacgcctgtcagcagctacttccatgttcccaaggccgcattcaccggatatttcagcatattcagcatcaccatggtcgccttcctgccggtggccggatggctgatgcaccgctacgatctgcgcatcgtactgaccgcaagcaccgtcctggctggactgggctgcctgggtatgtcccgatcatccgccatgtggcagttctatctatgcggagtggttctgggaatcggcatgccggccgtcctctatctgtcagtgccaacactcatcaacgcctggttccgcaagcgggtcgggttcttcatcggcctgtgcatggccttcaccggcataggcggcgtgatcttcaaccagataggcaccatgatcatcagatccgcccctgatggatggaggcggggatatctggttttcgctattctcatcctggtgatcaccctgcccttcaccattttcgtcattcgcagcacacccgaacagatgggtctgcatccctacggcgccgaccaggagcctgatgcagctgagacggccaccaatagtgcaggcaccgggagcaaagaccaaaagagtcctgagcctgcagcgtcaaccgtaggcatgactgcctcccaggccttgcgctcccctgccttctgggcgctggcgctcttctgcggtctgatcaccatgaatcagaccatttaccagttcctgccctcctacgcggcatccctgccatccatggcagcctacacgggactgatcgcctcctcctgcatggccggccaggccatcggcaagatcatcctgggcatggtcaacgacggcagcatcgtaggcggtctctgtctgggcatcggcggcggcattctcggcgtctgcctcatggtcgccttccccggattgcccgtgctcctcctgctgggagcctttgccttcggccttgtctacgcctgcactactgtgcagacaccaatcctggttacagcggtcttcggctcgcgcgactacaccaacatctatgcacgtatccagatggttgggtccctagcctcggccttcgcagctctcttctggggcgccatcgctgaccagccccacggctacatcatcatgttcggtctgagcatcctgatcatggttgtggccttgttcctaggcattatccctctgaaaggtacgcgcaagttgaccgatcagatcgcctga

SEQ ID NO: 111 - protein, 440 aa, Lactobacillus johnsonii
MSTTPTQPSSRKQAVYPYLIVLSGIVFTAIPVSLVCSCAGIFFTPVSSYFHVPKAAFTGYFSIFSITMVAFLPVAGWLMHRYDLRIVLTASTVLAGLGCLGMSRSSAMWQFYLCGVVLGIGMPAVLYLSVPTLINAWFRKRVGFFIGLCMAFTGIGGVIFNQIGTMIIRSAPDGWRRGYLVFAILILVITLPFTIFVIRSTPEQMGLHPYGADQEPDAAETATNSAGTGSKDQKSPEPAASTVGMTASQALRSPAFWALALFCGLITMNQTIYQFLPSYAASLPSMAAYTGLIASSCMAGQAIGKIILGMVNDGSIVGGLCLGIGGGILGVCLMVAFPGLPVLLLLGAFAFGLVYACTTVQTPILVTAVFGSRDYTNIYARIQMVGSLASAFAALFWGAIADQPHGYIIMFGLSILIMVVALFLGIIPLKGTRKLTDQIA

SEQ ID NO: 112 - DNA, 1356 bp, Lactobacillus johnsonii
atgtctactgatgccgctactaaagataaagtagtaagcaagggctataaatacttcatggttttcctttgtatgttaacccaagctattccttatggaattgctcaaaacattcagcctttgtttatccaccctttagttaatactttccactttaccttagcatcgtacacattaatttttacgtttggtgcggtttttgcttcagttgcttctccatttattggtaaggcattagaaaaagttaacttccgactaatgtatttaattggtattggtctttctgctattgcctacgtaatttttggaattagtacaaaactacccggtttctatattgccgctatcatttgtatggttggttcaaccttttactccggccaaggtgttccctgggttattaaccactggttcccagcaaagggacgtggggctgccttaggaattgccttctgcggtggttctattggtaatatctttttacaaccagcaacccaagctattttaaaacactacatgacaggtaatactaagaccggtcatttaacctctatggcaccattctttatctttgccgtagctttattagtaatcggtgtaattatcgcctgcttcattagaacccctaagaaagacgaaattgttgtttctgatgcagaactagctgaaagcaagaaagctgaagccgcagccaaagctaaagagtttaaaggctggactagtaaacaagtgttacaaatgaaatggttctggattttcagccttggtttcttaatcattggtttaggcttagcttctttaaatgaagactatgccgccttccttgatactaagctttctttaaccgatgttggtttagttgggtcaatgtacggtgttggttgtttaatcggaaatatttctggtggtttcttatttgataaatttggtacagcaaaatcaatgacctatgctggttgtatgtatattttatctattctgatgatgatctttattagcttccagccatatggttcatctattagtaaggctgctggcattggctatgctatcttttgcggcttagctgtatttagttacatgtcaggcccagccttcatggcaaaagacctctttggttcaagagatcaaggtgtcatgcttggatacgttggtttagcttatgcaattggctatgccattggtgctccactatttgggattattaagggagcggcaagctttacagttgcttggtactttatgattgcctttgttgcaattggttttatcattttagtatttgccgttatccaaattaagagataccaaaagaaatacattgcagagcaagcagcaaaagctaatgctaaataa

SEQ ID NO: 113 - protein, 451 aa, Lactobacillus johnsonii
MSTDAATKDKVVSKGYKYFMVFLCMLTQAIPYGIAQNIQPLFIHPLVNTFHFTLASYTLIFTFGAVFASVASPFIGKALEKVNFRLMYLIGIGLSAIAYVIFGISTKLPGFYIAAIICMVGSTFYSGQGVPWVINHWFPAKGRGAALGIAFCGGSIGNIFLQPATQAILKHYMTGNTKTGHLTSMAPFFIFAVALLVIGVIIACFIRTPKKDEIVVSDAELAESKKAEAAAKAKEFKGWTSKQVLQMKWFWIFSLGFLIIGLGLASLNEDYAAFLDTKLSLTDVGLVGSMYGVGCLIGNISGGFLFDKFGTAKSMTYAGCMYILSILMMIFISFQPYGSSISKAAGIGYAIFCGLAVFSYMSGPAFMAKDLFGSRDQGVMLGYVGLAYAIGYAIGAPLFGIIKGAASFTVAWYFMIAFVAIGFIILVFAVIQIKRYQKKYIAEQAAKANAK

SEQ ID NO: 114 - DNA, 4775 bp, Homo sapiens
gaatgatgaaaaccgaggttggaaaaggttgtgaaaccttttaactctccacagtggagtccattatttcctctggcttcctcaaattcatattcacagggtcgttggctgtgggttgcaattaccatgtctgactcagtaattcttcgaagtataaagaaatttggagaggagaatgatggttttgagtcagataaatcatataataatgataagaaatcaaggttacaagatgagaagaaaggtgatggcgttagagttggcttctttcaattgtttcggttttcttcatcaactgacatttggctgatgtttgtgggaagtttgtgtgcatttctccatggaatagcccagccaggcgtgctactcatttttggcacaatgacagatgtttttattgactacgacgttgagttacaagaactccagattccaggaaaagcatgtgtgaataacaccattgtatggactaacagttccctcaaccagaacatgacaaatggaacacgttgtgggttgctgaacatcgagagcgaaatgatcaaatttgccagttactatgctggaattgctgtcgcagtacttatcacaggatatattcaaatatgcttttgggtcattgccgcagctcgtcagatacagaaaatgagaaaattttactttaggagaataatgagaatggaaatagggtggtttgactgcaattcagtgggggagctgaatacaagattctctgatgatattaataaaatcaatgatgccatagctgaccaaatggcccttttcattcagcgcatgacctcgaccatctgtggtttcctgttgggatttttcaggggttggaaactgaccttggttattatttctgtcagccctctcattgggattggagcagccaccattggtctgagtgtgtccaagtttacggactatgagctgaaggcctatgccaaagcaggggtggtggctgatgaagtcatttcatcaatgagaacagtggctgcttttggtggtgagaaaagagaggttgaaaggtatgagaaaaatcttgtgttcgcccagcgttggggaattagaaaaggaatagtgatgggattctttactggattcgtgtggtgtctcatctttttgtgttatgcactggccttctggtacggctccacacttgtcctggatgaaggagaatatacaccaggaacccttgtccagattttcctcagtgtcatagtaggagctttaaatcttggcaatgcctctccttgtttggaagcctttgcaactggacgtgcagcagccaccagcatttttgagacaatagacaggaaacccatcattgactgcatgtcagaagatggttacaagttggatcgaatcaagggtgaaattgaattccataatgtgaccttccattatccttccagaccagaggtgaagattctaaatgacctcaacatggtcattaaaccaggggaaatgacagctctggtaggacccagtggagctggaaaaagtacagcactgcaactcattcagcgattctatgacccctgtgaaggaatggtgaccgtggatggccatgacattcgctctcttaacattcagtggcttagagatcagattgggatagtggagcaagagccagttctgttctctaccaccattgcagaaaatattcgctatggcagagaagatgcaacaatggaagacatagtccaagctgccaaggaggccaatgcctacaacttcatcatggacctgccacagcaatttgacacccttgttggagaaggaggaggccagatgagtggtggccagaaacaaagggtagctatcgccagagccctcatccgaaatcccaagattctgcttttggacatggccacctcagctctggacaatgagagtgaagccatggtgcaagaagtgctgagtaagattcagcatgggcacacaatcatttcagttgctcatcgcttgtctacggtcagagctgcagataccatcattggttttgaacatggcactgcagtggaaagagggacccatgaagaattactggaaaggaaaggtgtttacttcactctagtgactttgcaaagccagggaaatcaagctcttaatgaagaggacataaaggatgcaactgaagatgacatgcttgcgaggacctttagcagagggagctaccaggatagtttaagggcttccatccggcaacgctccaagtctcagctttcttacctggtgcacgaacctccattagctgttgtagatcataagtctacctatgaagaagatagaaaggacaaggacattcctgtgcaggaagaagttgaacctgccccagttaggaggattctgaaattcagtgctccagaatggccctacatgctggtagggtctgtgggtgcagctgtgaacgggacagtcacacccttgtatgcctttttattcagccagattcttgggactttttcaattcctgataaagaggaacaaaggtcacagatcaatggtgtgtgcctactttttgtagcaatgggctgtgtatctcttttcacccaatttctacagggatatgcctttgctaaatctggggagctcctaacaaaaaggctacgtaaatttggtttcagggcaatgctggggcaagatattgcctggtttgatgacctcagaaatagccctggagcattgacaacaagacttgctacagatgcttcccaagttcaaggggctgccggctctcagatcgggatgatagtcaattccttcactaacgtcactgtggccatgatcattgccttctcctttagctggaagctgagcctggtcatcttgtgcttcttccccttcttggctttatcaggagccacacagaccaggatgttgacaggatttgcctctcgagataagcaggccctggagatggtgggacagattacaaatgaagccctcagtaacatccgcactgttgctggaattggaaaggagaggcggttcattgaagcacttgagactgagctggagaagcccttcaagacagccattcagaaagccaatatttacggattctgctttgcctttgcccagtgcatcatgtttattgcgaattctgcttcctacagatatggaggttacttaatctccaatgaggggctccatttcagctatgtgttcagggtgatctctgcagttgtactgagtgcaacagctcttggaagagccttctcttacaccccaagttatgcaaaagctaaaatatcagctgcacgcttttttcaactgctggaccgacaacccccaatcagtgtatacaatactgcaggtgaaaaatgggacaacttccaggggaagattgattttgttgattgtaaatttacatatccttctcgacctgactcgcaagttctgaatggtctctcagtgtcgattagtccagggcagacactggcgtttgttgggagcagtggatgtggcaaaagcactagcattcagctgttggaacgtttctatgatcctgatcaagggaaggtgatgatagatggtcatgacagcaaaaaagtaaatgtccagttcctccgctcaaacattggaattgtttcccaggaaccagtgttgtttgcctgtagcataatggacaatatcaagtatggagacaacaccaaagaaattcccatggaaagagtcatagcagctgcaaaacaggctcagctgcatgattttgtcatgtcactcccagagaaatatgaaactaacgttgggtcccaggggtctcaactctctagaggggagaaacaacgcattgctattgctcgggccattgtacgagatcctaaaatcttgctactagatgaagccacttctgccttagacacagaaagtgaaaagacggtgcaggttgctctagacaaagccagagagggtcggacctgcattgtcattgcccatcgcttgtccaccatccagaacgcggatatcattgctgtcatggcacagggggtggtgattgaaaaggggacccatgaagaactgatggcccaaaaaggagcctactacaaactagtcaccactggatcccccatcagttgacccaatgcaagaatctcagacacacatgacgcaccagttacaggggttgtttttaaagaaaaaaacaatcccagcaggagggattgctgggattgttttttctttaaagaagaatgttaatattttacttttacagtcattttcctacatcggaatccaagctaatttctaatggccttccataataattctgctttagatgtgtatacagaaaatgaaagaaactagggtccatatgagggaaaacccaatgtcaagtggcagctcagccaccactcagtgcttctctgtgcaggagccagtcctgattaatatgtgggaattagtgagacatcagggagtaagtgacactttgaactcctcaagggcagagaactgtctttcatttttgaaccctcggtgtacacagaggcgggtctataacaggcaatcaacaaacgtttcttgagctagaccaaggtcagatttgaaaagaacagaaggactgaagaccagctgtgtttcttaactaaatttgtctttcaagtgaaaccagcttccttcatctctaaggctaaggatagggaaagggtggatgctctcaggctgagggaggcagaaagggaaagtattagcatgagctttccagttagggctgttgatttatgctttaacttcagagtgagtgtaggggtggtgatgct

SEQ ID NO: 115 - protein, 1321 aa, Homo sapiens
MSDSVILRSIKKFGEENDGFESDKSYNNDKKSRLQDEKKGDGVRVGFFQLFRFSSSTDIWLMFVGSLCAFLHGIAQPGVLLIFGTMTDVFIDYDVELQELQIPGKACVNNTIVWTNSSLNQNMTNGTRCGLLNIESEMIKFASYYAGIAVAVLITGYIQICFWVIAAARQIQKMRKFYFRRIMRMEIGWFDCNSVGELNTRFSDDINKINDAIADQMALFIQRMTSTICGFLLGFFRGWKLTLVIISVSPLIGIGAATIGLSVSKFTDYELKAYAKAGVVADEVISSMRTVAAFGGEKREVERYEKNLVFAQRWGIRKGIVMGFFTGFVWCLIFLCYALAFWYGSTLVLDEGEYTPGTLVQIFLSVIVGALNLGNASPCLEAFATGRAAATSIFETIDRKPIIDCMSEDGYKLDRIKGEIEFHNVTFHYPSRPEVKILNDLNMVIKPGEMTALVGPSGAGKSTALQLIQRFYDPCEGMVTVDGHDIRSLNIQWLRDQIGIVEQEPVLFSTTIAENIRYGREDATMEDIVQAAKEANAYNFIMDLPQQFDTLVGEGGGQMSGGQKQRVAIARALIRNPKILLLDMATSALDNESEAMVQEVLSKIQHGHTIISVAHRLSTVRAADTIIGFEHGTAVERGTHEELLERKGVYFTLVTLQSQGNQALNEEDIKDATEDDMLARTFSRGSYQDSLRASIRQRSKSQLSYLVHEPPLAVVDHKSTYEEDRKDKDIPVQEEVEPAPVRRILKFSAPEWPYMLVGSVGAAVNGTVTPLYAFLFSQILGTFSIPDKEEQRSQINGVCLLFVAMGCVSLFTQFLQGYAFAKSGELLTKRLRKFGFRAMLGQDIAWFDDLRNSPGALTTRLATDASQVQGAAGSQIGMIVNSFTNVTVAMIIAFSFSWKLSLVILCFFPFLALSGATQTRMLTGFASRDKQALEMVGQITNEALSNIRTVAGIGKERRFIEALETELEKPFKTAIQKANIYGFCFAFAQCIMFIANSASYRYGGYLISNEGLHFSYVFRVISAVVLSATALGRAFSYTPSYAKAKISAARFFQLLDRQPPISVYNTAGEKWDNFQGKIDFVDCKFTYPSRPDSQVLNGLSVSISPGQTLAFVGSSGCGKSTSIQLLERFYDPDQGKVMIDGHDSKKVNVQFLRSNIGIVSQEPVLFACSIMDNIKYGDNTKEIPMERVIAAAKQAQLHDFVMSLPEKYETNVGSQGSQLSRGEKQRIAIARAIVRDPKILLLDEATSALDTESEKTVQVALDKAREGRTCIVIAHRLSTIQNADIIAVMAQGVVIEKGTHEELMAQKGAYYKLVTTGSPIS

SEQ ID NO: 116 - protein, 57 aa, Streptococcus thermophilus
MEGRTVFVIAHRLSTIVNSDVILVMDHGRIIKRGDHDTLMEQGGTYYRLYTGSLEID

SEQ ID NO: 117 - DNA, 150 bp, Nostoc sp.
atgtgggggaaacaaagacaaagaatcgccattgcacgagggggttttaagaatttgcaggttttgattttagataaagcaacctcggcattggataataaaacagaagcagctattgagcgatcgctggtgttgactgttgaccaatga

SEQ ID NO: 118 - protein, 49 aa, Nostoc sp.
MWGKQRQRIAIARGGFKNLQVLILDKATSALDNKTEAAIERSLVLTVDQ

SEQ ID NO: 119 - DNA, 948 bp, Neisseria meningitides
atgaatatcctcagtaaaatcagcagctttatcggaaaaacattttccctctgggccgcgctctttgccgccgccgcttttttcgcgcccgacaccttcaaatgggcggggccttatattccttggctgttgggcattattatgttcggtatgggtttgacgctcaaaccttccgacttcgatattttgttcaaacatcccaaagtcgtcatcatcggcgtaatcgcacaattcgccattatgccggcaaccgcctggctgctgtccaaactgttgaacctgcctgccgaaatcgcggtcggcgtgattttggtcggctgctgcccgggcggtacggcttccaatgtgatgacctatctggcgcgtggcaatgtggctttgtcggttgccgttacgtctgtttccaccctgatttccccattgctgactcccgccatcttcctgatgcttgccggcgaaatgctggaaatccaagcggccggtatgttgatgtccatcgtcaaaatggttttgctccccattgttttgggtttgattgtccataaggttttgggcagtaaaaccgaaaagctgaccgatgcgctgccgctggtttccgttgccgccatcgtgctgattatcggcgcggttgttggggcaagcaaaggcaagattatggaaagcggcctgctgatttttgcggttgtcgtactccacaacggcatcggctacctgctcggcttctttgccgccaaatggaccggcctgccttatgatgcacaaaaaacgctgaccatcgaagtcggtatgcaaaactcgggcctggccgccgcgcttgccgccgcacactttgccgccgcgccggtcgttgccgttccgggcgcattgttcagcgtgtggcacaatatctccggctcgctgctggcaacttattgggcggccaaagccggtaaacataaaaaaccctaa

SEQ ID NO: 120 - protein, 323 aa, Neisseria meningitides
MNILSKISSFIGKTFSLWAALFAAAAFFAPDTFKWAGPYIPWLLGIIMFGMGLTLKPSDFDILFKHPKVVIIGVIAQFAIMPATAWLLSKLLNLPAEIAVGVILVGCCPGGTASNVMTYLARGNVALSVAVTSVSTLISPLLTPAIFLMLAGEMLEIQAAGMLMSIVKMVLLPIVLGLIVHKVLGSKTEKLTDALPLVSVAAIVLIIGAVVGASKGKIMESGLLIFAVVVLHNGIGYLLGFFAAKWTGLPYDAQKTLTIEVGMQNSGLAAALAAAHFAAAPVVAVPGALFSVWHNISGSLLATYWAAKAGKHKKPGSENLYFQ

SEQ ID NO: 121 - DNA, 7584 bp, Artificial Sequence
  source: /note="Description of Artificial Sequence: Synthetic polynucleotide"
taagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatgcaaacacaaaaaccgactctcgaactgctaacctgcgaaggcgcttatcgcgacaacccgactgcgctttttcaccagttgtgtggggatcgtccggcaacgctgctgctggaatccgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttctaatggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaacattccggccggtttaaccatcaacgcccattttaatggcatggtgatggcggtgcgtcacgatgcagatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcacagacgcttagccaacaagaaagccaccagctgttttcagcggtggtacgtggcgagctgaagccggaacaactggcggcggcgctggtgagcatgaaaattcgcggtgaacacccgaacgagatcgccggggcagcaaccgcgctactggaaaacgccgcgccattcccgcgcccggattatctgtttgccgatatcgtcggtactggcggtgacggcagcaacagcatcaatatttctaccgccagtgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcgccgaagtatcacaccggattccgccatgcgatgccggttcgccagcaactgaaaacccgcactctgttcaacgtgctgggaccattgattaacccggcgcatccgccgctggcgctaattggtgtttatagtccggaactggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcaattgaccgctgaagattttggcctgacaccctaccaccaggagcaattggcaggcggaacaccggaagaaaaccgtgacattttaacacgcttgttacaaggtaaaggcgacgccgcccatgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaaatgatgcaaaccgttttagcgaaaatcgtcgcagacaaggcgatttgggtagaaacccgcaaagagcagcaaccgctggccagttttcagaatgaggttcagccgagcacgcgacatttttatgatgcacttcagggcgcacgcacggcgtttattctggagtgtaaaaaagcgtcgccgtcaaaaggcgtgatccgtgatgatttcgatccggcacgcattgccgccatttataaacattacgcttcggcaatttcagtgctgactgatgagaaatattttcaggggagctttgatttcctccccatcgtcagccaaatcgccccgcagccgattttatgtaaagacttcattatcgatccttaccagatctatctggcgcgctattaccaggccgatgcctgcttattaatgctttcagtactggatgacgaacaatatcgccagcttgcagccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaacgtgacggtaatcagcgaatccggcatcaatacttacgctcaggtgcgcgagttaagccacttcgctaacggctttctgattggttcggcgttgatggcccatgacgatttgaacgccgccgtgcgtcgggtgttgctgggtgagaataaagtatgtggcctgacacgtgggcaagatgctaaagcagcttatgacgcgggcgcgatttacggtgggttgatttttgttgcgacatcaccgcgttgcgtcaacgttgaacaggcgcaggaagtgatggctgcagcaccgttgcagtatgttggcgtgttccgcaatcacgatattgccgatgtggcggacaaagctaaggtgttatcgctggcggcagtgcaactgcatggtaatgaagatcagctgtatatcgacaatctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaaggaaaggaacaatgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctgatggaacgctacgaatctctgtttgcccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgagatgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgccgaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagccgcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagttaatacgcatggcatggatgaccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtggccagtgccaagcttgcatgcgtgc

SEQ ID NO: 122 - DNA, 623 bp, Artificial Sequence
  source: /note="Description of Artificial Sequence: Synthetic polynucleotide"
taagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacat

SEQ ID NO: 123 - DNA, 124 bp, Artificial Sequence
  source: /note="Description of Artificial Sequence: Synthetic polynucleotide"
cattaattcctaatttttgttgacactctatcattgatagagttattttaccactccctatcagtgatagagaaaagtgaactctagaaataattttgtttaactttaagaaggagatatacat

SEQ ID NO: 124 - DNA, 1562 bp, Artificial Sequence
  source: /note="Description of Artificial Sequence: Synthetic polynucleotide"
atgcaaacacaaaaaccgactctcgaactgctaacctgcgaaggcgcttatcgcgacaacccgactgcgctttttcaccagttgtgtggggatcgtccggcaacgctgctgctggaatccgcagatatcgacagcaaagatgatttaaaaagcctgctgctggtagacagtgcgctgcgcattacagcattaagtgacactgtcacaatccaggcgctttccggcaatggagaagccctgttgacactactggataacgccttgcctgcgggtgtggaaaatgaacaatcaccaaactgccgcgtactgcgcttcccgcctgtcagtccactgctggatgaagacgcccgcttatgctccctttcggtttttgacgctttccgcttattacagaatctgttgaatgtaccgaaggaagaacgagaagcaatgttcttcggcggcctgttctcttatgaccttgtggcgggatttgaaaatttaccgcaactgtcagcggaaaatagctgccctgatttctgtttttatctcgctgaaacgctgatggtgattgaccatcagaaaaaaagcactcgtattcaggccagcctgtttgctccgaatgaagaagaaaaacaacgtctcactgctcgcctgaacgaactacgtcagcaactgaccgaagccgcgccgccgctgccggtggtttccgtgccgcatatgcgttgtgaatgtaaccagagcgatgaagagttcggtggtgtagtgcgtttgttgcaaaaagcgattcgcgccggagaaattttccaggtggtgccatctcgccgtttctctctgccctgcccgtcaccgctggcagcctattacgtgctgaaaaagagtaatcccagcccgtacatgttttttatgcaggataatgatttcaccctgtttggcgcgtcgccggaaagttcgctcaagtatgacgccaccagccgccagattgagatttacccgattgccggaacacgtccacgcggtcgtcgtgccgatggttcgctggacagagacctcgacagccgcatcgaactggagatgcgtaccgatcataaagagctttctgaacatctgatgctggtggatctcgcccgtaatgacctggcacgcatttgcacacccggcagccgctacgtcgccgatctcaccaaagttgaccgttactcttacgtgatgcacctagtctcccgcgttgttggtgagctgcgccacgatctcgacgccctgcacgcttaccgcgcctgtatgaatatggggacgttaagcggtgcaccgaaagtacgcgctatgcagttaattgccgaagcagaaggtcgtcgacgcggcagctacggcggcgcggtaggttattttaccgcgcatggcgatctcgacacctgcattgtgatccgctcggcgctggtggaaaacggtatcgccaccgtgcaagccggtgctggcgtagtccttgattctgttccgcagtcggaagccgacgaaactcgtaataaagcccgcgctgtactgcgcgctattgccaccgcgcatcatgcacaggagacgttcta

SEQ ID NO: 125 - protein, 520 aa, Artificial Sequence
  source: /note="Description of Artificial Sequence: Synthetic polypeptide"
MQTQKPTLELLTCEGAYRDNPTALFHQLCGDRPATLLLESADIDSKDDLKSLLLVDSALRITALSDTVTIQALSGNGEALLTLLDNALPAGVENEQSPNCRVLRFPPVSPLLDEDARLCSLSVFDAFRLLQNLLNVPKEEREAMFFGGLFSYDLVAGFENLPQLSAENSCPDFCFYLAETLMVIDHQKKSTRIQASLFAPNEEEKQRLTARLNELRQQLTEAAPPLPVVSVPHMRCECNQSDEEFGGVVRLLQKAIRAGEIFQVVPSRRFSLPCPSPLAAYYVLKKSNPSPYMFFMQDNDFTLFGASPESSLKYDATSRQIEIYPIAGTRPRGRRADGSLDRDLDSRIELEMRTDHKELSEHLMLVDLARNDLARICTPGSRYVADLTKVDRYSYVMHLVSRVVGELRHDLDALHAYRACMNMGTLSGAPKVRAMQLIAEAEGRRRGSYGGAVGYFTAHGDLDTCIVIRSALVENGIATVQAGAGVVLDSVPQSEADETRNKARAVLRAIATAHHAQETF

SEQ ID NO: 126 - DNA, 1596 bp, Artificial Sequence
  source: /note="Description of Artificial Sequence: Synthetic polynucleotide"
atggctgacattctgctgctcgataatatcgactcttttacgtacaacctggcagatcagttgcgcagcaatggtcataacgtggtgatttaccgcaaccatattccggcgcagaccttaattgaacgcctggcgacgatgagcaatccggtgctgatgctttctcctggccccggtgtgccgagcgaagccggttgtatgccggaactcctcacccgcttgcgtggcaagctgccaattattggcatttgcctcggacatcaggcgattgtcgaagcttacgggggctatgtcggtcaggcgggcgaaattcttcacggtaaagcgtcgagcattgaacatgacggtcaggcgatgtttgccggattaacaaacccgctgccagtggcgcgttatcactcgctggttggcagtaacattccggccggtttaaccatcaacgcccattttaatggcatggtgatggcggtgcgtcacgatgcagatcgcgtttgtggattccagttccatccggaatccattcttactacccagggcgctcgcctgctggaacaaacgctggcctgggcgcagcagaaactagagccaaccaacacgctgcaaccgattctggaaaaactgtatcaggcacagacgcttagccaacaagaaagccaccagctgttttcagcggtggtacgtggcgagctgaagccggaacaactggcggcggcgctggtgagcatgaaaattcgcggtgaacacccgaacgagatcgccggggcagcaaccgcgctactggaaaacgccgcgccattcccgcgcccggattatctgtttgccgatatcgtcggtactggcggtgacggcagcaacagcatcaatatttctaccgccagtgcgtttgtcgccgcggcctgcgggctgaaagtggcgaaacacggcaaccgtagcgtctccagtaaatccggctcgtcggatctgctggcggcgttcggtattaatcttgatatgaacgccgataaatcgcgccaggcgctggatgagttaggcgtctgtttcctctttgcgccgaagtatcacaccggattccgccatgcgatgccggttcgccagcaactgaaaacccgcactctgttcaacgtgctgggaccattgattaacccggcgcatccgccgctggcgctaattggtgtttatagtccggaactggtgctgccgattgccgaaaccttgcgcgtgctggggtatcaacgcgcggcagtggtgcacagcggcgggatggatgaagtttcattacacgcgccgacaatcgttgccgaactacatgacggcgaaattaagagctatcaattgaccgctgaagattttggcctgacaccctaccaccaggagcaattggcaggcggaacaccggaagaaaaccgtgacattttaacacgcttgttacaaggtaaaggcgacgccgcccatgaagcagccgtcgcggcgaatgtcgccatgttaatgcgcctgcatggccatgaagatctgcaagccaatgcgcaaaccgttcttgaggtactgcgcagtggttccgcttacgacagagtcaccgcactggcggcacgagggtaa

SEQ ID NO: 127 - protein, 531 aa, Artificial Sequence
  source: /note="Description of Artificial Sequence: Synthetic polypeptide"
MADILLLDNIDSFTYNLADQLRSNGHNVVIYRNHIPAQTLIERLATMSNPVLMLSPGPGVPSEAGCMPELLTRLRGKLPIIGICLGHQAIVEAYGGYVGQAGEILHGKASSIEHDGQAMFAGLTNPLPVARYHSLVGSNIPAGLTINAHFNGMVMAVRHDADRVCGFQFHPESILTTQGARLLEQTLAWAQQKLEPTNTLQPILEKLYQAQTLSQQESHQLFSAVVRGELKPEQLAAALVSMKIRGEHPNEIAGAATALLENAAPFPRPDYLFADIVGTGGDGSNSINISTASAFVAAACGLKVAKHGNRSVSSKSGSSDLLAAFGINLDMNADKSRQALDELGVCFLFAPKYHTGFRHAMPVRQQLKTRTLFNVLGPLINPAHPPLALIGVYSPELVLPIAETLRVLGYQRAAVVHSGGMDEVSLHAPTIVAELHDGEIKSYQLTAEDFGLTPYHQEQLAGGTPEENRDILTRLLQGKGDAAHEAAVAANVAMLMRLHGHEDLQANAQTVLEVLRSGSAYDRVTALAARG

SEQ ID NO: 128 - DNA, 1359 bp, Artificial Sequence
  source: /note="Description of Artificial Sequence: Synthetic polynucleotide"
atgcaaaccgttttagcgaaaatcgtcgcagacaaggcgatttgggtagaaacccgcaaagagcagcaaccgctggccagttttcagaatgaggttcagccgagcacgcgacatttttatgatgcacttcagggcgcacgcacggcgtttattctggagtgtaaaaaagcgtcgccgtcaaaaggcgtgatccgtgatgatttcgatccggcacgcattgccgccatttataaacattacgcttcggcaatttcagtgctgactgatgagaaatattttcaggggagctttgatttcctccccatcgtcagccaaatcgccccgcagccgattttatgtaaagacttcattatcgatccttaccagatctatctggcgcgctattaccaggccgatgcctgcttattaatgctttcagtactggatgacgaacaatatcgccagcttgcagccgtcgcccacagtctggagatgggtgtgctgaccgaagtcagtaatgaagaggaactggagcgcgccattgcattgggggcaaaggtcgttggcatcaacaaccgcgatctgcgcgatttgtcgattgatctcaaccgtacccgcgagcttgcgccgaaactggggcacaacgtgacggtaatcagcgaatccggcatcaatacttacgctcaggtgcgcgagttaagccacttcgctaacggctttctgattggttcggcgttgatggcccatgacgatttgaacgccgccgtgcgtcgggtgttgctgggtgagaataaagtatgtggcctgacacgtgggcaagatgctaaagcagcttatgacgcgggcgcgatttacggtgggttgatttttgttgcgacatcaccgcgttgcgtcaacgttgaacaggcgcaggaagtgatggctgcagcaccgttgcagtatgttggcgtgttccgcaatcacgatattgccgatgtggcggacaaagctaaggtgttatcgctggcggcagtgcaactgcatggtaatgaagatcagctgtatatcgacaatctgcgtgaggctctgccagcacacgtcgccatctggaaggctttaagtgtcggtgaaactcttcccgcgcgcgattttcagcacatcgataaatatgtattcgacaacggtcagggcgggagcggacaacgtttcgactggtcactattaaatggtcaatcgcttggcaacgttctgctggcggggggcttaggcgcagataactgcgtggaagcggcacaaaccggctgcgccgggcttgattttaattctgctgtagagtcgcaaccgggtatcaaagacgcacgtcttttggcctcggttttccagacgctgcgcgcatattaa

SEQ ID NO: 129 - protein, 452 aa, Artificial Sequence
  source: /note="Description of Artificial Sequence: Synthetic polypeptide"
MQTVLAKIVADKAIWVETRKEQQPLASFQNEVQPSTRHFYDALQGARTAFILECKKASPSKGVIRDDFDPARIAAIYKHYASAISVLTDEKYFQGSFDFLPIVSQIAPQPILCKDFIIDPYQIYLARYYQADACLLMLSVLDDEQYRQLAAVAHSLEMGVLTEVSNEEELERAIALGAKVVGINNRDLRDLSIDLNRTRELAPKLGHNVTVISESGINTYAQVRELSHFANGFLIGSALMAHDDLNAAVRRVLLGENKVCGLTRGQDAKAAYDAGAIYGGLIFVATSPRCVNVEQAQEVMAAAPLQYVGVFRNHDIADVADKAKVLSLAAVQLHGNEDQLYIDNLREALPAHVAIWKALSVGETLPARDFQHIDKYVFDNGQGGSGQRFDWSLLNGQSLGNVLLAGGLGADNCVEAAQTGCAGLDFNSAVESQPGIKDARLLASVFQTLRAY

SEQ ID NO: 130 - DNA, 1194 bp, Artificial Sequence
  source: /note="Description of Artificial Sequence: Synthetic polynucleotide"
atgacaacattacttaacccctattttggtgagtttggcggcatgtacgtgccacaaatcctgatgcctgctctgcgccagctggaagaagcttttgtcagcgcgcaaaaagatcctgaatttcaggctcagttcaacgacctgctgaaaaactatgccgggcgtccaaccgcgctgaccaaatgccagaacattacagccgggacgaacaccacgctgtatctgaagcgcgaagatttgctgcacggcggcgcgcataaaactaaccaggtgctcggtcaggctttactggcgaagcggatgggtaaaactgaaattattgccgaaaccggtgccggtcagcatggcgtggcgtcggcccttgccagcgccctgctcggcctgaaatgccgaatttatatgggtgccaaagacgttgaacgccagtcgcccaacgttttccggatgcgcttaatgggtgcggaagtgatcccggtacatagcggttccgcgaccctgaaagatgcctgtaatgaggcgctacgcgactggtccggcagttatgaaaccgcgcactatatgctgggtaccgcagctggcccgcatccttacccgaccattgtgcgtgagtttcagcggatgattggcgaagaaacgaaagcgcagattctggaaagagaaggtcgcctgccggatgccgttatcgcctgtgttggcggtggttcgaatgccatcggtatgtttgcagatttcatcaacgaaaccgacgtcggcctgattggtgtggagcctggcggccacggtatcgaaactggcgagcacggcgcaccgttaaaacatggtcgcgtgggcatctatttcggtatgaaagcgccgatgatgcaaaccgaagacgggcaaattgaagagtcttactccatttctgccgggctggatttcccgtccgtcggcccgcaacatgcgtatctcaacagcactggacgcgctgattacgtgtctattaccgacgatgaagccctggaagcctttaaaacgctttgcctgcatgaagggatcatcccggcgctggaatcctcccacgccctggcccatgcgctgaaaatgatgcgcgaaaatccggaaaaagagcagctactggtggttaacctttccggtcgcggcgataaagacatcttcaccgttcacgatattttgaaagcacgaggggaaatctga

SEQ ID NO: 131 - protein, 397 aa, Artificial Sequence
  source: /note="Description of Artificial Sequence: Synthetic polypeptide"
MTTLLNPYFGEFGGMYVPQILMPALRQLEEAFVSAQKDPEFQAQFNDLLKNYAGRPTALTKCQNITAGTNTTLYLKREDLLHGGAHKTNQVLGQALLAKRMGKTEIIAETGAGQHGVASALASALLGLKCRIYMGAKDVERQSPNVFRMRLMGAEVIPVHSGSATLKDACNEALRDWSGSYETAHYMLGTAAGPHPYPTIVREFQRMIGEETKAQILEREGRLPDAVIACVGGGSNAIGMFADFINETDVGLIGVEPGGHGIETGEHGAPLKHGRVGIYFGMKAPMMQTEDGQIEESYSISAGLDFPSVGPQHAYLNSTGRADYVSITDDEALEAFKTLCLHEGIIPALESSHALAHALKMMRENPEKEQLLVVNLSGRGDKDIFTVHDILKARGEI

SEQ ID NO: 132 - DNA, 807 bp, Artificial Sequence
  source: /note="Description of Artificial Sequence: Synthetic polynucleotide"
atggaacgctacgaatctctgtttgcccagttgaaggagcgcaaagaaggcgcattcgttcctttcgtcaccctcggtgatccgggcattgagcagtcgttgaaaattatcgatacgctaattgaagccggtgctgacgcgctggagttaggcatccccttctccgacccactggcggatggcccgacgattcaaaacgccacactgcgtgcttttgcggcgggagtaaccccggcgcagtgctttgagatgctggcactcattcgccagaagcacccgaccattcccatcggccttttgatgtatgccaacctggtgtttaacaaaggcattgatgagttttatgccgagtgcgagaaagtcggcgtcgattcggtgctggttgccgatgtgcccgtggaagagtccgcgcccttccgccaggccgcgttgcgtcataatgtcgcacctatctttatttgcccgccgaatgccgacgatgatttgctgcgccagatagcctcttacggtcgtggttacacctatttgctgtcgcgagcgggcgtgaccggcgcagaaaaccgcgccgcgttacccctcaatcatctggttgcgaagctgaaagagtacaacgctgcgcctccattgcagggatttggtatttccgccccggatcaggtaaaagccgcgattgatgcaggagctgcgggcgcgatttctggttcggccatcgttaaaatcatcgagcaacatattaatgagccagagaaaatgctggcggcactgaaagcttttgtacaaccgatgaaagcggcgacgcgcagttaa

SEQ ID NO: 133 - protein, 268 aa, Artificial Sequence
  source: /note="Description of Artificial Sequence: Synthetic polypeptide"
MERYESLFAQLKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKMLAALKAFVQPMKAATRS

SEQ ID NO: 134 - protein, 416 aa, Pseudomonas sp.
MTTRNDCLALDAQDSLAPLRQQFALPEGVIYLDGNSLGARPVAALARAQAVIAEEWGNGLIRSWNSAGWRDLSERLGNRLATLIGARDGEVVVTDTTSINLFKVLSAALRVQATRSPERRVIVTETSNFPTDLYIAEGLADMLQQGYTLRLVDSPEELPQAIDQDTAVVMLTHVNYKTGYMHDMQALTALSHECGALAIWDLAHSAGAVPVDLHQAGADYAIGCTYKYLNGGPGSQAFVWVSPQLCDLVPQPLSGWFGHSRQFAMEPRYEPSNGIARYLCGTQPITSLAMVECGLDVFAQTDMASLRRKSLALTDLFIELVEQRCAAHELTLVTPREHAKRGSHVSFEHPEGYAVIQALIDRGVIGDYREPRIMRFGFTPLYTTFTEVWDAVQILGEILDRKTWAQAQFQVRHSVT

SEQ ID NO: 135 - protein, 465 aa, Homo sapiens
MEPSSLELPADTVQRIAAELKCHPTDERVALHLDEEDKLRHFRECFYIPKIQDLPPVDLSLVNKDENAIYFLGNSLGLQPKMVKTYLEEELDKWAKIAAYGHEVGKRPWITGDESIVGLMKDIVGANEKEIALMNALTVNLHLLMLSFFKPTPKRYKILLEAKAFPSDHYAIESQLQLHGLNIEESMRMIKPREGEETLRIEDILEVIEKEGDSIAVILFSGVHFYTGQHFNIPAITKAGQAKGCYVGFDLAHAVGNVELYLHDWGVDFACWCSYKYLNAGAGGIAGAFIHEKHAHTIKPALVGWFGHELSTRFKMDNKLQLIPGVCGFRISNPPILLVCSLHASLEIFKQATMKALRKKSVLLTGYLEYLIKHNYGKDKAATKKPVVNIITPSHVEERGCQLTITFSVPNKDVFQELEKRGVVCDKRNPNGIRVAPVPLYNSFHDVYKFTNLLTSILDSAETKN

SEQ ID NO: 136 - protein, 378 aa, Shewanella sp.
MLLNVKQDFCLAGPGYLLNHSVGRPLKSTEQALKQAFFAPWQESGREPWGQWLGVIDNFTAALASLFNGQPQDFCPQVNLSSALTKIVMSLDRLTRDLTRNGGAVVLMSEIDFPSMGFALKKALPASCELRFIPKSLDVTDPNVWDAHICDDVDLVFVSHAYSNTGQQAPLAQIISLARERGCLSLVDVAQSAGILPLDLAKLQPDFMIGSSVKWLCSGPGAAYLWVNPAILPECQPQDVGWFSHENPFEFDIHDFRYHPTALRFWGGTPSIAPYAIAAHSIEYFANIGSQVMREHNLQLMEPVVQALDNELVSPQEVDKRSGTIILQFGERQPQILAALAAANISVDTRSLGIRVSPHIYNDEADIARLLGVIKANR

SEQ ID NO: 137 - DNA, 1424 bp, Pseudomonas sp.
atctaatctagacatcattaattcctaatttttgttgacactctatcattgatagagttattttaccactccctatcagtgatagagaaaagtgaattatataaaagtgggaggtgcccgaatgacgacccgaaatgattgcctagcgttggatgcacaggacagtctggctccgctgcgccaacaatttgcgctgccggagggtgtgatatacctggatggcaattcgctgggcgcacgtccggtagctgcgctggctcgcgcgcaggctgtgatcgcagaagaatggggcaacgggttgatccgttcatggaactctgcgggctggcgtgatctgtctgaacgcctgggtaatcgcctggctaccctgattggtgcgcgcgatggggaagtagttgttactgataccacctcgattaatctgtttaaagtgctgtcagcggcgctgcgcgtgcaagctacccgtagcccggagcgccgtgttatcgtgactgagacctcgaatttcccgaccgacctgtatattgcggaagggttggcggatatgctgcaacaaggttacactctgcgtttggtggattcaccggaagagctgccacaggctatagatcaggacaccgcggtggtgatgctgacgcacgtaaattataaaaccggttatatgcacgacatgcaggctctgaccgcgttgagccacgagtgtggggctctggcgatttgggatctggcgcactctgctggcgctgtgccggtggacctgcaccaagcgggcgcggactatgcgattggctgcacgtacaaatacctgaatggcggcccgggttcgcaagcgtttgtttgggtttcgccgcaactgtgcgacctggtaccgcagccgctgtctggttggttcggccatagtcgccaattcgcgatggagccgcgctacgaaccttctaacggcattgctcgctatctgtgcggcactcagcctattactagcttggctatggtggagtgcggcctggatgtgtttgcgcagacggatatggcttcgctgcgccgtaaaagtctggcgctgactgatctgttcatcgagctggttgaacaacgctgcgctgcacacgaactgaccctggttactccacgtgaacacgcgaaacgcggctctcacgtgtcttttgaacaccccgagggttacgctgttattcaagctctgattgatcgtggcgtgatcggcgattaccgtgagccacgtattatgcgtttcggtttcactcctctgtatactacttttacggaagtttgggatgcagtacaaatcctgggcgaaatcctggatcgtaagacttgggcgcaggctcagtttcaggtgcgccactctgttacttaaaaataaaacgaaaggctcagtcgaaagactgggcctttcgttttatctgttg

SEQ ID NO: 138 - DNA, 1571 bp, Homo sapiens
atctaatctagacatcattaattcctaatttttgttgacactctatcattgatagagttattttaccactccctatcagtgatagagaaaagtgaatatcaagacacgaggaggtaagattatggagccttcatctttagaactgccagcggacacggtgcagcgcatcgcggcggaactgaagtgccatccgactgatgagcgtgtggcgctgcatctggacgaagaagataaactgcgccactttcgtgaatgtttttatattcctaaaattcaagacttgccgccggtagatttgagtctcgttaacaaagatgaaaacgcgatctactttctgggcaactctctgggtctgcaaccaaaaatggttaaaacgtacctggaggaagaactggataaatgggcaaaaatcgcggcttatggtcacgaagtgggcaagcgtccttggattactggcgacgagtctattgtgggtttgatgaaagatattgtgggcgcgaatgaaaaggaaattgcactgatgaatgctctgaccgttaatctgcacctgctgatgctgtctttttttaaaccgaccccgaaacgctacaaaatactgctggaagcgaaagcgtttccgtcggatcactatgctatagaaagtcaactgcagttgcatggtctgaatatcgaggaatctatgcgcatgattaaaccgcgtgagggtgaagaaacgctgcgtattgaagacattctggaagttattgaaaaagaaggtgattctatcgcagttatactgttttctggcgtgcacttttatacaggtcagcacttcaatatcccggcaatcactaaagcggggcaggcaaaaggctgctatgttggttttgacctggcgcatgcagtggggaatgttgaactgtatctgcacgattggggcgttgatttcgcgtgttggtgtagctacaaatatctgaacgctggcgcgggtggcattgctggcgcttttattcacgaaaaacacgcgcacaccattaaaccggctctggttggctggttcggtcatgagctgagtactcgctttaaaatggataacaaactgcaattgattccgggtgtttgcggcttccgtatcagcaatccgccgattctgctggtttgcagcctgcacgctagtctggaaatctttaagcaggcgactatgaaagcgctgcgcaaaaaatctgtgctgctgaccggctatctggagtatctgatcaaacacaattatggcaaagataaagctgcaactaaaaaaccggtagtgaacattatcaccccctcacacgtggaggagcgcggttgtcagctgactattactttcagtgtacctaataaagatgtgttccaggaactggaaaaacgcggcgttgtttgtgataaacgtaacccgaatggtattcgcgtggctcctgtgccgctgtacaattcattccacgatgtttataaattcaccaacctgctgacttctattctcgacagtgctgagactaaaaattaaaaataaaacgaaaggctcagtcgaaagactgggcctttcgttttatctgttg

SEQ ID NO: 139 - DNA, 1310 bp, Shewanella sp.
atctaatctagacatcattaattcctaatttttgttgacactctatcattgatagagttattttaccactccctatcagtgatagagaaaagtgaatggttcaccaccacaaggagggattatgctgctgaatgtaaaacaggacttttgcctggcaggcccgggctacctgctgaatcactcggttggccgtccgctgaaatcaactgagcaagcgctgaaacaagcattttttgctccgtggcaagagagcggtcgtgaaccgtggggccagtggctgggtgttattgataatttcactgctgcgctggcatctctgtttaatggtcaaccgcaggatttttgtccgcaggttaacctgagcagcgcgctgactaaaattgtgatgtcactggatcgtctgactcgcgatctgacccgcaatggcggtgctgttgtgctgatgtctgaaatcgatttcccatctatgggcttcgcgttgaaaaaagcgctgccagcgagctgcgaactgcgttttatcccgaaaagtctggacgtgactgatccgaacgtatgggatgcacacatctgtgatgatgtagacctggtttttgtgtctcacgcctatagtaatacgggccaacaggctccgctggcgcaaatcatctctctggcgcgtgaacgtggctgcctgtcactggtggatgtagcgcaatcagcggggattttgccgctggatctggcgaaactgcaaccggacttcatgatcggcagttcggttaaatggctgtgctcgggccctggtgcggcatatctgtgggttaatccggcgattctgccggaatgtcagccgcaggatgtgggctggttttcacatgagaatccctttgaattcgacatccacgatttccgctaccacccgactgcactgcgcttttggggtggtacgccgtcgatcgcgccttatgcgatcgcggcgcactcgatcgaatattttgccaatatcggctcgcaagtgatgcgtgaacacaacctgcaactgatggaaccggtggttcaggcgctggacaatgaactggtgagcccgcaggaagtggataaacgctcaggcactattattctgcaattcggtgaacgtcaaccgcaaattctggcggctctggctgcggcgaacatttcggtggacactcgttctttggggattcgtgttagtccgcacatttataatgatgaggcggacattgcgcgcctgctgggtgtgatcaaagcaaatcgctaaaaataaaacgaaaggctcagtcgaaagactgggcctttcgttttatctgttg

SEQ ID NO: 140 - protein, 490 aa, Ruminococcus gnavus
MSQVIKKKRNTFMIGTEYILNSTQLEEAIKSFVHDFCAEKHEIHDQPVVVEAKEHQEDKIKQIKIPEKGRPVNEVVSEMMNEVYRYRGDANHPRFFSFVPGPASSVSWLGDIMTSAYNIHAGGSKLAPMVNCIEQEVLKWLAKQVGFTENPGGVFVSGGSMANITALTAARDNKLTDINLHLGTAYISDQTHSSVAKGLRIIGITDSRIRRIPTNSHFQMDTTKLEEAIETDKKSGYIPFVVIGTAGTTNTGSIDPLTEISALCKKHDMWFHIDGAYGASVLLSPKYKSLLTGTGLADSISWDAHKWLFQTYGCAMVLVKDIRNLFHSFHVNPEYLKDLENDIDNVNTWDIGMELTRPARGLKLWLTLQVLGSDLIGSAIEHGFQLAVWAEEALNPKKDWEIVSPAQMAMINFRYAPKDLTKEEQDILNEKISHRILESGYAAIFTTVLNGKTVLRICAIHPEATQEDMQHTIDLLDQYGREIYTEMKKA

SEQ ID NO: 141 - DNA, 1470 bp, Ruminococcus gnavus
atgagtcaagtgattaagaagaaacgtaacacctttatgatcggaacggagtacattcttaacagtacacaattggaggaagcgattaaatcattcgtacatgatttctgcgcagagaagcatgagatccatgatcaacctgtggtagtagaagctaaagaacatcaggaggacaaaatcaaacaaatcaaaatcccggaaaagggacgtcctgtaaatgaagtcgtttctgagatgatgaatgaagtgtatcgctaccgcggagacgccaaccatcctcgctttttttcttttgtgcccggacctgcaagcagtgtgtcgtggttgggggatattatgacgtccgcctacaatattcatgctggaggctcaaagctggcaccgatggttaactgcattgagcaggaagttctgaagtggttagcaaagcaagtggggttcacagaaaatccaggtggcgtatttgtgtcgggcggttcaatggcgaatattacggcacttactgcggctcgtgacaataaactgaccgacattaaccttcatttgggaactgcttatattagtgaccagactcatagttcagttgcgaaaggattacgcattattggaatcactgacagtcgcatccgtcgcattcccactaactcccacttccagatggataccaccaagctggaggaagccatcgagaccgacaagaagtctggctacattccgttcgtcgttatcggaacagcaggtaccaccaacactggttcgattgaccccctgacagaaatctctgcgttatgtaagaagcatgacatgtggtttcatatcgacggagcgtatggagctagtgttctgctgtcacctaagtacaagagccttcttaccggaaccggcttggctgacagtatttcgtgggatgctcataaatggttgttccaaacgtacggctgtgcaatggtacttgtcaaagatatccgtaatttattccactcttttcatgtgaatcccgagtatcttaaggatctggaaaacgacatcgataacgttaatacatgggacatcggcatggagctgacgcgccctgcacgcggtcttaaattgtggcttactttacaggtccttggatctgacttgattgggagtgccattgaacacggtttccagctggcagtttgggctgaggaagcattgaatccaaagaaagactgggagatcgtttctccagctcagatggctatgattaatttccgttatgcccctaaggatttaaccaaagaggaacaggatattctgaatgaaaagatctcccaccgcattttagagagcggatacgctgcaattttcactactgtattaaacggcaagaccgttttacgcatctgtgcaattcacccggaggcaactcaagaggatatgcaacacacaatcgacttattagaccaatacggtcgtgaaatctataccgagatgaagaaagcg

SEQ ID NO: 142 - protein, 444 aa, Cryptococcus deuterogattii
MTATTISIETVPQAPAAGTKTNGTSGKYNPRTYLSDRAKVTEIDGSDAGRPNPDTFPFNSITLNLKPPLGLPESSNNMPVSITIEDPDLATALQYAPSAGIPKLREWLADLQAHVHERPRGDYAISVGSGSQDLMFKGFQAVLNPGDPVLLETPMYSGVLPALRILKADYAEVDVDDQGLSAKNLEKVLSEWPADKKRPRVLYTSPIGSNPSGCSASKERKLEVLKVCKKYDVLIFEDDPYYYLAQELIPSYFALEKQVYPEGGHVVRFDSFSKLLSAGMRLGFATGPKEILHAIDVSTAGANLHTSAVSQGVALRLMQYWGIEGFLAHGRAVAKLYTERRAQFEATAHKYLDGLATWVSPVAGMFLWIDLRPAGIEDSYELIRHEALAKGVLGVPGMAFYPTGRKSSHVRVSFSIVDLEDESDLGFQRLAEAIKDKRKALGLA

SEQ ID NO: 143 - DNA, 1332 bp, Cryptococcus deuterogattii
atgacggcaactacaatttctattgagaccgtacctcaggccccggcggcggggaccaaaactaatgggacttcaggaaaatacaacccccgcacttacctgtccgaccgcgccaaagtcactgagattgatggatctgacgccggtcgccccaatcccgatactttcccatttaactcgattaccttaaatttgaaaccacctttaggcttgcccgagagttcaaataacatgccggtctctatcacgattgaagaccccgatttagcgacggccttacaatatgcacctagcgccggtattcctaagctgcgcgaatggctggctgacttacaagctcacgttcatgagcgcccccgtggcgattatgccatctcggtcgggtcggggtcacaggatttgatgtttaagggcttccaagctgtcttgaatccaggtgatccagtccttctggaaaccccaatgtattcaggtgttctgccagcgctgcgcattctgaaggcggattatgcagaagttgatgtagacgaccaggggttatctgctaaaaaccttgaaaaagttttatcagagtggcccgcagataagaagcgtcctcgtgtcctgtatacgtcgccaatcggctccaatccttccggatgttcagcatccaaggaacgcaagttagaggtactgaaagtctgtaagaagtacgatgtgctgatcttcgaagacgatccgtattattaccttgctcaagagcttattccatcctattttgcgttggaaaaacaagtttatccggagggtgggcacgttgtacgctttgactcatttagtaaattgctttctgctgggatgcgcttgggatttgctacagggccgaaggaaattcttcatgcgattgacgtcagtacagcaggcgcaaatttacatacttcagcggtctctcaaggtgtcgctcttcgcctgatgcagtattgggggatcgagggattccttgcacatggccgcgcggtggccaaactttacacggagcgccgcgctcagttcgaggcaaccgcacataagtacctggacgggctggccacttgggtatctcccgtagcgggaatgtttttatggatcgatcttcgtccagcaggaatcgaagattcttacgaattaattcgccatgaagcattagccaaaggcgttttaggcgttccagggatggcgttttatccgacaggccgtaagtcttcccatgttcgtgtcagtttcagtatcgtcgacctggaagacgaatctgaccttggttttcaacgcctggctgaagctattaaggataaacgcaaggctttagggctggct

SEQ ID NO: 144 - protein, 500 aa, Catharanthus roseus
MGSIDSTNVAMSNSPVGEFKPLEAEEFRKQAHRMVDFIADYYKNVETYPVLSEVEPGYLRKRIPETAPYLPEPLDDIMKDIQKDIIPGMTNWMSPNFYAFFPATVSSAAFLGEMLSTALNSVGFTWVSSPAATELEMIVMDWLAQILKLPKSFMFSGTGGGVIQNTTSESILCTIIAARERALEKLGPDSIGKLVCYGSDQTHTMFPKTCKLAGIYPNNIRLIPTTVETDFGISPQVLRKMVEDDVAAGYVPLFLCATLGTTSTTATDPVDSLSEIANEFGIWIHVDAAYAGSACICPEFRHYLDGIERVDSLSLSPHKWLLAYLDCTCLWVKQPHLLLRALTTNPEYLKNKQSDLDKVVDFKNWQIATGRKFRSLKLWLILRSYGVVNLQSHIRSDVAMGKMFEEWVRSDSRFEIVVPRNFSLVCFRLKPDVSSLHVEEVNKKLLDMLNSTGRVYMTHTIVGGIYMLRLAVGSSLTEEHHVRRVWDLIQKLTDDLLKEA

SEQ ID NO: 145 - protein, 757 aa, Escherichia coli
MGSPSLYSARKTTLALAVALSFAWQAPVFAHGGEAHMVPMDKTLKEFGADVQWDDYAQLFTLIKDGAYVKVKPGAQTAIVNGQPLALQVPVVMKDNKAWVSDTFINDVFQSGLDQTFQVEKRPHPLNALTADEIKQAVEIVKASADFKPNTRFTEISLLPPDKEAVWAFALENKPVDQPRKADVIMLDGKHIIEAVVDLQNNKLLSWQPIKDAHGMVLLDDFASVQNIINNSEEFAAAVKKRGITDAKKVITTPLTVGYFDGKDGLKQDARLLKVISYLDVGDGNYWAHPIENLVAVVDLEQKKIVKIEEGPVVPVPMTARPFDGRDRVAPAVKPMQIIEPEGKNYTITGDMIHWRNWDFHLSMNSRVGPMISTVTYNDNGTKRKVMYEGSLGGMIVPYGDPDIGWYFKAYLDSGDYGMGTLTSPIARGKDAPSNAVLLNETIADYTGVPMEIPRAIAVFERYAGPEYKHQEMGQPNVSTERRELVVRWISTVGNYDYIFDWIFHENGTIGIDAGATGIEAVKGVKAKTMHDETAKDDTRYGTLIDHNIVGTTHQHIYNFRLDLDVDGENNSLVAMDPVVKPNTAGGPRTSTMQVNQYNIGNEQDAAQKFDPGTIRLLSNPNKENRMGNPVSYQIIPYAGGTHPVAKGAQFAPDEWIYHRLSFMDKQLWVTRYHPGERFPEGKYPNRSTHDTGLGQYSKDNESLDNTDAVVWMTTGTTHVARAEEWPIMPTEWVHTLLKPWNFFDETPTLGALKKDK

SEQ ID NO: 146 - protein, 1368 aa, Arabidopsis thaliana
MGEKAIDEDKVEAMKSSKTSLVFAINGQRFELELSSIDPSTTLVDFLRNKTPFKSVKLGCGEGGCGACVVLLSKYDPLLEKVDEFTISSCLTLLCSIDGCSITTSDGLGNSRVGFHAVHERIAGFHATQCGFCTPGMSVSMFSALLNADKSHPPPRSGFSNLTAVEAEKAVSGNLCRCTGYRPLVDACKSFAADVDIEDLGFNAFCKKGENRDEVLRRLPCYDHTSSHVCTFPEFLKKEIKNDMSLHSRKYRWSSPVSVSELQGLLEVENGLSVKLVAGNTSTGYYKEEKERKYERFIDIRKIPEFTMVRSDEKGVELGACVTISKAIEVLREEKNVSVLAKIATHMEKIANRFVRNTGTIGGNIMMAQRKQFPSDLATILVAAQATVKIMTSSSSQEQFTLEEFLQQPPLDAKSLLLSLEIPSWHSAKKNGSSEDSILLFETYRAAPRPLGNALAFLNAAFSAEVTEALDGIVVNDCQLVFGAYGTKHAHRAKKVEEFLTGKVISDEVLMEAISLLKDEIVPDKGTSNPGYRSSLAVTFLFEFFGSLTKKNAKTTNGWLNGGCKEIGFDQNVESLKPEAMLSSAQQIVENQEHSPVGKGITKAGACLQASGEAVYVDDIPAPENCLYGAFIYSTMPLARIKGIRFKQNRVPEGVLGIITYKDIPKGGQNIGTNGFFTSDLLFAEEVTHCAGQIIAFLVADSQKHADIAANLVVIDYDTKDLKPPILSLEEAVENFSLFEVPPPLRGYPVGDITKGMDEAEHKILGSKISFGSQYFFYMETQTALAVPDEDNCMVVYSSTQTPEFVHQTIAGCLGVPENNVRVITRRVGGGFGGKAVKSMPVAAACALAASKMQRPVRTYVNRKTDMITTGGRHPMKVTYSVGFKSNGKITALDVEVLLDAGLTEDISPLMPKGIQGALMKYDWGALSFNVKVCKTNTVSRTALRAPGDVQGSYIGEAIIEKVASYLSVDVDEIRKVNLHTYESLRLFHSAKAGEFSEYTLPLLWDRIDEFSGFNKRRKVVEEFNASNKWRKRGISRVPAVYAVNMRSTPGRVSVLGDGSIVVEVQGIEIGQGLWTKVKQMAAYSLGLIQCGTTSDELLKKIRVIQSDTLSMVQGSMTAGSTTSEASSEAVRICCDGLVERLLPVKTALVEQTGGPVTWDSLISQAYQQSINMSVSSKYMPDSTGEYLNYGIAASEVEVNVLTGETTILRTDIIYDCGKSLNPAVDLGQIEGAFVQGLGFFMLEEFLMNSDGLVVTDSTWTYKIPTVDTIPRQFNVEILNSGQHKNRVLSSKASGEPPLLLAASVHCAVRAAVKEARKQILSWNSNKQGTDMYFELPVPATMPIVKEFCGLDVVEKYLEWKIQQRKNV

SEQ ID NO: 147 - protein, 513 aa, Saccharomyces cerevisiae
MTAGSAPPVDYTSLKKNFQPFLSRRVENRSLKSFWDASDISDDVIELAGGMPNERFFPIESMDLKISKVPFNDNPKWHNSFTTAHLDLGSPSELPIARSFQYAETKGLPPLLHFVKDFVSRINRPAFSDETESNWDVILSGGSNDSMFKVFETICDESTTVMIEEFTFTPAMSNVEATGAKVIPIKMNLTFDRESQGIDVEYLTQLLDNWSTGPYKDLNKPRVLYTIATGQNPTGMSVPQWKREKIYQLAQRHDFLIVEDDPYGYLYFPSYNPQEPLENPYHSSDLTTERYLNDFLMKSFLTLDTDARVIRLETFSKIFAPGLRLSFIVANKFLLQKILDLADITTRAPSGTSQAIVYSTIKAMAESNLSSSLSMKEAMFEGWIRWIMQIASKYNHRKNLTLKALYETESYQAGQFTVMEPSAGMFIIIKINWGNFDRPDDLPQQMDILDKFLLKNGVKVVLGYKMAVCPNYSKQNSDFLRLTIAYARDDDQLIEASKRIGSGIKEFFDNYKS

SEQ ID NO: 148 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 149 - protein, 391 aa, Arabidopsis thaliana
MVKLENSRKPEKISNKNIPMSDFVVNLDHGDPTAYEEYWRKMGDRCTVTIRGCDLMSYFSDMTNLCWFLEPELEDAIKDLHGVVGNAATEDRYIVVGTGSTQLCQAAVHALSSLARSQPVSVVAAAPFYSTYVEETTYVRSGMYKWEGDAWGFDKKGPYIELVTSPNNPDGTIRETVVNRPDDDEAKVIHDFAYYWPHYTPITRRQDHDIMLFTFSKITGHAGSRIGWALVKDKEVAKKMVEYIIVNSIGVSKESQVRTAKILNVLKETCKSESESENFFKYGREMMKNRWEKLREVVKESDAFTLPKYPEAFCNYFGKSLESYPAFAWLGTKEETDLVSELRRHKVMSRAGERCGSDKKHVRVSMLSREDVFNVFLERLANMKLIKSIDL

SEQ ID NO: 150 - protein, 504 aa, Streptomyces sp.
MTAPLQDSDGPDDAIGGPKQVTVIGAGIAGLVTAYELERLGHHVQIIEGSDDIGGRIHTHRFSGAGGPGPFAEMGAMRIPAGHRLTMHYIAELGLQNQVREFRTLFSDDAAYLPSSAGYLRVREAHDTLVDEFATGLPSAHYRQDTLLFGAWLDASIRAIAPRQFYDGLHNDIGVELLNLVDDIDLTPYRCGTARNRIDLHALFADHPRVRASCPPRLERFLDDVLDETSSSIVRLKDGMDELPRRLASRIRGKISLGQEVTGIDVHDDTVTLTVRQGLRTVTRTCDYVVCTIPFTVLRTLRLTGFDQDKLDIVHETKYWPATKIAFHCREPFWEKDGISGGASFTGGHVRQTYYPPAEGDPALGAVLLASYTIGPDAEALARMDEAERDALVAKELSVMHPELRRPGMVLAVAGRDWGARRWSRGAATVRWGQEAALREAERRECARPQKGLFFAGEHCSSKPAWIEGAIESAIDAAHEIEWYEPRASRVFAASRLSRSDRSA

SEQ ID NO: 151 - protein, 552 aa, Enterobacter cloacae
MRTPYCVADYLLDRLTDCGADHLFGVPGDYNLQFLDHVIDSPDICWVGCANELNASYAADGYARCKGFAALLTTFGVGELSAMNGIAGSYAEHVPVLHIVGAPGTAAQQRGELLHHTLGDGEFRHFYHMSEPITVAQAVLTEQNACYEIDRVLTTMLRERRPGYLMLPADVAKKAATPPVNALTHKQAHADSACLKAFRDAAENKLAMSKRTALLADFLVLRHGLKHALQKWVKEVPMAHATMLMGKGIFDERQAGFYGTYSGSASTGAVKEAIEGADTVLCVGTRFTDTLTAGFTHQLTPAQTIEVQPHAARVGDVWFTGIPMNQAIETLVELCKQHVHAGLMSSSSGAIPFPQPDGSLTQENFWRTLQTFIRPGDIILADQGTSAFGAIDLRLPADVNFIVQPLWGSIGYTLAAAFGAQTACPNRRVIVLTGDGAAQLTIQELGSMLRDKQHPIILVLNNEGYTVERAIHGAEQRYNDIALWNWTHIPQALSLDPQSECWRVSEAEQLADVLEKVAHHERLSLIEVMLPKADIPPLLGALTKALEACNNA

SEQ ID NO: 152 - protein, 497 aa, Ustilago maydis
MPTLNLDLPNGIKSTIQADLFINNKFVPALDGKTFATINPSTGKEIGQVAEASAKDVDLAVKAAREAFETTWGENTPGDARGRLLIKLAELVEANIDELAAIESLDNGKAFSIAKSFDVAAVAANLRYYGGWADKNHGKVMEVDTKRLNYTRHEPIGVCGQIIPWNFPLLMFAWKLGPALATGNTIVLKTAEQTPLSAIKMCELIVEAGFPPGVVNVISGFGPVAGAAISQHMDIDKIAFTGSTLVGRNIMKAAASTNLKKVTLELGGKSPNIIFKDADLDQAVRWSAFGIMFNHGQCCCAGSRVYVEESIYDAFMEKMTAHCKALQVGDPFSANTFQGPQVSQLQYDRIMEYIESGKKDANLALGGVRKGNEGYFIEPTIFTDVPHDAKIAKEEIFGPVVVVSKFKDEKDLIRIANDSIYGLAAAVFSRDISRAIETAHKLKAGTVWVNCYNQLIPQVPFGGYKASGIGRELGEYALSNYTNIKAVHVNLSQPAPI

SEQ ID NO: 153 - protein, 415 aa, Arabidopsis thaliana
MEFVTETLGKRIHDPYVEETRCLMIPGPIIVGSGPSGLATAACLKSRDIPSLILERSTCIASLWQHKTYDRLRLHLPKDFCELPLMPFPSSYPTYPTKQQFVQYLESYAEHFDLKPVFNQTVEEAKFDRRCGLWRVRTTGGKKDETMEYVSRWLVVATGENAEEVMPEIDGIPDFGGPILHTSSYKSGEIFSEKKILVVGCGNSGMEVCLDLCNFNALPSLVVRDSVHVLPQEMLGISTFGISTSLLKWFPVHVVDRFLLRMSRLVLGDTDRLGLVRPKLGPLERKIKCGKTPVLDVGTLAKIRSGHIKVYPELKRVMHYSAEFVDGRVDNFDAIILATGYKSNVPMWLKGVNMFSEKDGFPHKPFPNGWKGESGLYAVGFTKLGLLGAAIDAKKIAEDIEVQRHFLPLARPQHC

SEQ ID NO: 154 - protein, 557 aa, Pseudomonas savastanoi
MYDHFNSPSIDILYDYGPFLKKCEMTGGIGSYSAGTPTPRVAIVGAGISGLVAATELLRAGVKDVVLYESRDRIGGRVWSQVFDQTRPRYIAEMGAMRFPPSATGLFHYLKKFGISTSTTFPDPGVVDTELHYRGKRYHWPAGKKPPELFRRVYEGWQSLLSEGYLLEGGSLVAPLDITAMLKSGRLEEAAIAWQGWLNVFRDCSFYNAIVCIFTGRHPPGGDRWARPEDFELFGSLGIGSGGFLPVFQAGFTEILRMVINGYQSDQRLIPDGISSLAARLADQSFDGKALRDRVCFSRVGRISREAEKIIIQTEAGEQRVFDRVIVTSSNRAMQMIHCLTDSESFLSRDVARAVRETHLTGSSKLFILTRTKFWIKNKLPTTIQSDGLVRGVYCLDYQPDEPEGHGVVLLSYTWEDDAQKMLAMPDKKTRCQVLVDDLAAIHPTFASYLLPVDGDYERYVLHHDWLTDPHSAGAFKLNYPGEDVYSQRLFFQPMTANSPNKDTGLYLAGCSCSFAGGWIEGAVQTALNSACAVLRSTGGQLSKGNPLDCINASYRY

SEQ ID NO: 155 - protein, 455 aa, Pseudomonas savastanoi
MHEIITLESLCQALADGEIAAAELRERALDTEARLARLNCFIREGDAVSQFGEADHAMKGTPLWGMPVSFKDNICVRGLPLTAGTRGMSGFVSDQDAAIVSQLRALGAVVAGKNNMHELSFGVTSINPHWGTVGNPVAPGYCAGGSSGGSAAAVASGIVPLSVGTDTGGSIRIPAAFCGITGFRPTTGRWSTAGIIPVSHTKDCVGLLTRTAGDAGFLYGLLSGKQQSFPLSRTAPCRIGLPVSMWSDLDGEVERACVNALSLLRKTGFEFIEIDDADIVELNQTLTFTVPLYEFFADLAQSLLSLGWKHGIHHIFAQVDDANVKGIINHHLGEGAIKPAHYLSSLQNGELLKRKMDELFARHNIELLGYPTVPCRVPHLDHADRPEFFSQAIRNTDLASNAMLPSITIPVGPEGRLPVGLSFDALRGRDALLLSRVSAIEQVLGFVRKVLPHTT

SEQ ID NO: 156 - protein, 353 aa, Nostoc punctiforme
MLLFETVREMGHEQVLFCHSKNPEIKAIIAIHDTTLGPAMGATRILPYINEEAALKDALRLSRGMTYKAACANIPAGGGKAVIIANPENKTDDLLRAYGRFVDSLNGRFITGQDVNITPDDVRTISQETKYVVGVSEKSGGPAPITSLGVFLGIKAAVESRWQSKRLDGMKVAVQGLGNVGKNLCRHLHEHDVQLFVSDVDPIKAEEVKRLFGATVVEPTEIYSLDVDIFAPCALGGILNSHTIPFLQASIIAGAANNQLENEQLHSQMLAKKGILYSPDYVINAGGLINVYNEMIGYDEEKAFKQVHNIYDTLLAIFEIAKEQGVTTNDAARRLAEDRINNSKRSKSKAIAA

SEQ ID NO: 157 - protein, 541 aa, Arabidopsis thaliana
MNTFTSNSSDLTTTATETSSFSTLYLLSTLQAFVAITLVMLLKKLMTDPNKKKPYLPPGPTGWPIIGMIPTMLKSRPVFRWLHSIMKQLNTEIACVKLGNTHVITVTCPKIAREILKQQDALFASRPLTYAQKILSNGYKTCVITPFGDQFKKMRKVVMTELVCPARHRWLHQKRSEENDHLTAWVYNMVKNSGSVDFRFMTRHYCGNAIKKLMFGTRTFSKNTAPDGGPTVEDVEHMEAMFEALGFTFAFCISDYLPMLTGLDLNGHEKIMRESSAIMDKYHDPIIDERIKMWREGKRTQIEDFLDIFISIKDEQGNPLLTADEIKPTIKELVMAAPDNPSNAVEWAMAEMVNKPEILRKAMEEIDRVVGKERLVQESDIPKLNYVKAILREAFRLHPVAAFNLPHVALSDTTVAGYHIPKGSQVLLSRYGLGRNPKVWADPLCFKPERHLNECSEVTLTENDLRFISFSTGKRGCAAPALGTALTTMMLARLLQGFTWKLPENETRVELMESSHDMFLAKPLVMVGDLRLPEHLYPTVK

SEQ ID NO: 158 - protein, 543 aa, Arabidopsis thaliana
MDTLASNSSDLTTKSSLGMSSFTNMYLLTTLQALAALCFLMILNKIKSSSRNKKLHPLPPGPTGFPIVGMIPAMLKNRPVFRWLHSLMKELNTEIACVRLGNTHVIPVTCPKIAREIFKQQDALFASRPLTYAQKILSNGYKTCVITPFGEQFKKMRKVIMTEIVCPARHRWLHDNRAEETDHLTAWLYNMVKNSEPVDLRFVTRHYCGNAIKRLMFGTRTFSEKTEADGGPTLEDIEHMDAMFEGLGFTFAFCISDYLPMLTGLDLNGHEKIMRESSAIMDKYHDPIIDERIKMWREGKRTQIEDFLDIFISIKDEAGQPLLTADEIKPTIKELVMAAPDNPSNAVEWAIAEMINKPEILHKAMEEIDRVVGKERFVQESDIPKLNYVKAIIREAFRLHPVAAFNLPHVALSDTTVAGYHIPKGSQVLLSRYGLGRNPKVWSDPLSFKPERHLNECSEVTLTENDLRFISFSTGKRGCAAPALGTAITTMMLARLLQGFKWKLAGSETRVELMESSHDMFLSKPLVLVGELRLSEDLYPMVK

SEQ ID NO: 159 - protein, 503 aa, Arabidopis thaliana
MSNIQEMEMILSISLCLTTLITLLLLRRFLKRTATKVNLPPSPWRLPVIGNLHQLSLHPHRSLRSLSLRYGPLMLLHFGRVPILVVSSGEAAQEVLKTHDHKFANRPRSKAVHGLMNGGRDVVFAPYGEYWRQMKSVCILNLLTNKMVESFEKVREDEVNAMIEKLEKASSSSSSENLSELFITLPSDVTSRVALGRKHSEDETARDLKKRVRQIMELLGEFPIGEYVPILAWIDGIRGFNNKIKEVSRGFSDLMDKVVQEHLEASNDKADFVDILLSIEKDKNSGFQVQRNDIKFMILDMFIGGTSTTSTLLEWTMTELIRSPKSMKKLQDEIRSTIRPHGSYIKEKEVENMKYLKAVIKEVLRLHPSLPMILPRLLSEDVKVKGYNIAAGTEVIINAWAIQRDTAIWGPDAEEFKPERHLDSGLDYHGKNLNYIPFGSGRRICPGINLALGLAEVTVANLVGRFDWRVEAGPNGDQPDLTEAIGIDVCRKFPLIAFPSSVV

SEQ ID NO: 160 - protein, 560 aa, Arabidopsis thaliana
MAHLQRTFPTEMSKGRASFPKGFLFGTASSSYQYEGAVNEGARGQSVWDHFSNRFPHRISDSSDGNVAVDFYHRYKEDIKRMKDINMDSFRLSIAWPRVLPYGKRDRGVSEEGIKFYNDVIDELLANEITPLVTIFHWDIPQDLEDEYGGFLSEQIIDDFRDYASLCFERFGDRVSLWCTMNEPWVYSVAGYDTGRKAPGRCSKYVNGASVAGMSGYEAYIVSHNMLLAHAEAVEVFRKCDHIKNGQIGIAHNPLWYEPYDPSDPDDVEGCNRAMDFMLGWHQHPTACGDYPETMKKSVGDRLPSFTPEQSKKLIGSCDYVGINYYSSLFVKSIKHVDPTQPTWRTDQGVDWMKTNIDGKQIAKQGGSEWSFTYPTGLRNILKYVKKTYGNPPILITENGYGEVAEQSQSLYMYNPSIDTERLEYIEGHIHAIHQAIHEDGVRVEGYYVWSLLDNFEWNSGYGVRYGLYYIDYKDGLRRYPKMSALWLKEFLRFDQEDDSSTSKKEEKKESYGKQLLHSVQDSQFVHSIKDSGALPAVLGSLFVVSATVGTSLFFKGANN

SEQ ID NO: 161 - protein, 346 aa, Arabidopsis thaliana
MSSTKDMSTVQNATPFNGVAPSTTVRVTIVQSSTVYNDTPATIDKAEKYIVEAASKGAELVLFPEGFIGGYPRGFRFGLAVGVHNEEGRDEFRKYHASAIHVPGPEVARLADVARKNHVYLVMGAIEKEGYTLYCTVLFFSPQGQFLGKHRKLMPTSLERCIWGQGDGSTIPVYDTPIGKLGAAICWENRMPLYRTALYAKGIELYCAPTADGSKEWQSSMLHIAIEGGCFVLSACQFCQRKHFPDHPDYLFTDWYDDKEHDSIVSQGGSVIISPLGQVLAGPNFESEGLVTADIDLGDIARAKLYFDSVGHYSRPDVLHLTVNEHPRKSVTFVTKVEKAEDDSNK

SEQ ID NO: 162 - protein, 403 aa, Homo sapiens [sequence omitted]

SEQ ID NO: 163 - protein, 406 aa, Homo sapiens
MSGCPFLGNNFGYTFKKLPVEGSEEDKSQTGVNRASKGGLIYGNYLHLEKVLNAQELQSETKGNKIHDEHLFIITHQAYELWFKQILWELDSVREIFQNGHVRDERNMLKVVSRMHRVSVILKLLVQQFSILETMTALDFNDFREYLSPASGFQSLQFRLLENKIGVLQNMRVPYNRRHYRDNFKGEENELLLKSEQEKTLLELVEAWLERTPGLEPHGFNFWGKLEKNITRGLEEEFIRIQAKEESEEKEEQVAEFQKQKEVLLSLFDEKRHEHLLSKGERRLSYRALQGALMIYFYREEPRFQVPFQLLTSLMDIDSLMTKWRYNHVCMVHRMLGSKAGTGGSSGYHYLRSTVSDRYKVFVDLFNLSTYLIPRHWIPKMNPTIHKFLYTAEYCDSSYFSSDESD

SEQ ID NO: 164 - protein, 453 aa, Saccharomyces cerevisiae
MNNTSITGPQVLHRTKMRPLPVLEKYCISPHHGFLDDRLPLTRLSSKKYMKWEEIVADLPSLLQEDNKVRSVIDGLDVLDLDETILGDVRELRRAYSILGFMAHAYIWASGTPRDVLPECIARPLLETAHILGVPPLATYSSLVLWNFKVTDECKKTETGCLDLENITTINTFTGTVDESWFYLVSVRFEKIGSACLNHGLQILRAIRSGDKGDANVIDGLEGLAATIERLSKALMEMELKCEPNVFYFKIRPFLAGWTNMSHMGLPQGVRYGAEGQYRIFSGGSNAQSSLIQTLDILLGVKHTANAAHSSQGDSKINYLDEMKKYMPREHREFLYHLESVCNIREYVSRNASNRALQEAYGRCISMLKIFRDNHIQIVTKYIILPSNSKQHGSNKPNVLSPIEPNTKASGCLGHKVASSKTIGTGGTRLMPFLKQCRDETVATADIKNEDKN

SEQ ID NO: 165 - protein, 305 aa, Mus musculus
MAFPSLSAGQNPWRNLSSEELEKQYSPSRWVIHTKPEEVVGNFVQIGSQATQKARATRRNQLDVPYGDGEGEKLDIYFPDEDSKAFPLFLFLHGGYWQSGSKDDSAFMVNPLTAQGIVVVIVAYDIAPKGTLDQMVDQVTRSVVFLQRRYPSNEGIYLCGHSAGAHLAAMVLLARWTKHGVTPNLQGFLLVSGIYDLEPLIATSQNDPLRMTLEDAQRNSPQRHLDVVPAQPVAPACPVLVLVGQHDSPEFHRQSKEFYETLLRVGWKASFQQLRGVDHFDIIENLTREDDVLTQIILKTVFQKL

SEQ ID NO: 166 - protein, 444 aa, Saccharomyces cerevisiae
MKQRFIRQFTNLMSTSRPKVVANKYFTSNTAKDVWSLTNEAAAKAANNSKNQGRELINLGQGFFSYSPPQFAIKEAQKALDIPMVNQYSPTRGRPSLINSLIKLYSPIYNTELKAENVTVTTGANEGILSCLMGLLNAGDEVIVFEPFFDQYIPNIELCGGKVVYVPINPPKELDQRNTRGEEWTIDFEQFEKAITSKTKAVIINTPHNPIGKVFTREELTTLGNICVKHNVVIISDEVYEHLYFTDSFTRIATLSPEIGQLTLTVGSAGKSFAATGWRIGWVLSLNAELLSYAAKAHTRICFASPSPLQEACANSINDALKIGYFEKMRQEYINKFKIFTSIFDELGLPYTAPEGTYFVLVDFSKVKIPEDYPYPEEILNKGKDFRISHWLINELGVVAIPPTEFYIKEHEKAAENLLRFAVCKDDAYLENAVERLKLLKDYL

SEQ ID NO: 167 - protein, 430 aa, Homo sapiens
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKVMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 168 - protein, 425 aa, Homo sapiens
MNYARFITAASAARNPSPIRTMTDILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLTSERKKEIYELARKYDFLIIEDDPYYFLQFNKFRVPTFLSMDVDGRVIRADSFSKIISSGLRIGFLTGPKPLIERVILHIQVSTLHPSTFNQLMISQLLHEWGEEGFMAHVDRVIDFYSNQKDAILAAADKWLTGLAEWHVPAAGMFLWIKVKGINDVKELIEEKAVKMGVLMLPGNAFYVDSSAPSPYLRASFSSASPEQMDVAFQVLAQLIKESL

SEQ ID NO: 169 - protein, 422 aa, Homo sapiens
MAKQLQARRLDGIDYNPWVEFVKLASEHDVVNLGQGFPDFPPPDFAVEAFQHAVSGDFMLNQYTKTFGYPPLTKILASFFGELLGQEIDPLRNVLVTVGGYGALFTAFQALVDEGDEVIIIEPFFDCYEPMTMMAGGRPVFVSLKPGPIQNGELGSSSNWQLDPMELAGKFTSRTKALVLNTPNNPLGKVFSREELELVASLCQQHDVVCITDEVYQWMVYDGHQHISIASLPGMWERTLTIGSAGKTFSATGWKVGWVLGPDHIMKHLRTVHQNSVFHCPTQSQAAVAESFEREQLLFRQPSSYFVQFPQAMQRCRDHMIRSLQSVGLKPIIPQGSYFLITDISDFKRKMPDLPGAVDEPYDRRFVKWMIKNKGLVAIPVSIFYSVPHQKHFDHYIRFCFVKDEATLQAMDEKLRKWKVEL

SEQ ID NO: 170 - protein, 454 aa, Homo sapiens
MFLAQRSLCSLSGRAKFLKTISSSKILGFSTSAKMSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEVILIVPFYDCYEPMVRMAGATPVFIPLRSKPVYGKRWSSSDWTLDPQELESKFNSKTKAIILNTPHNPLGKVYNREELQVIADLCIKYDTLCISDEVYEWLVYSGNKHLKIATFPGMWERTITIGSAGKTFSVTGWKLGWSIGPNHLIKHLQTVQQNTIYTCATPLQEALAQAFWIDIKRMDDPECYFNSLPKELEVKRDRMVRLLESVGLKPIVPDGGYFIIADVSLLDPDLSDMKNNEPYDYKFVKWMTKHKKLSAIPVSAFCNSETKSQFEKFVRFCFIKKDSTLDAAEEIIKAWSVQKS

SEQ ID NO: 171 - protein, 471 aa, Escherichia coli
MENFKHLPEPFRIRVIEPVKRTTRAYREEAIIKSGMNPFLLDSEDVFIDLLTDSGTGAVTQSMQAAMMRGDEAYSGSRSYYALAESVKNIFGYQYTIPTHQGRGAEQIYIPVLIKKREQEKGLDRSKMVAFSNYFFDTTQGHSQINGCTVRNVYIKEAFDTGVRYDFKGNFDLEGLERGIEEVGPNNVPYIVATITSNSAGGQPVSLANLKAMYSIAKKYDIPVVMDSARFAENAYFIKQREAEYKDWTIEQITRETYKYADMLAMSAKKDAMVPMGGLLCMKDDSFFDVYTECRTLCVVQEGFPTYGGLEGGAMERLAVGLYDGMNLDWLAYRIAQVQYLVDGLEEIGVVCQQAGGHAAFVDAGKLLPHIPADQFPAQALACELYKVAGIRAVEIGSFLLGRDPKTGKQLPCPAELLRLTIPRATYTQTHMDFIIEAFKHVKENAANIKGLTFTYEPKVLRHFTAKLKEV

SEQ ID NO: 172 - DNA, 290 bp, Unknown
  source: /note="Description of Unknown: FNR responsive promoter"
gtcagcataacaccctgacctctcattaattgttcatgccgggcggcactatcgtcgtccggccttttcctctcttactctgctacgtacatctatttctataaatccgttcaatttgtctgttttttgcacaaacatgaaatatcagacaattccgtgacttaagaaaatttatacaaatcagcaatataccccttaaggagtatataaaggtgaatttgatttacatcaataagcggggttgctgaatcgttaaggtaggcggtaatagaaaagaaatcgaggcaaaa

SEQ ID NO: 173 - DNA, 173 bp, Unknown
  source: /note="Description of Unknown: FNR responsive promoter"
atttcctctcatcccatccggggtgagagtcttttcccccgacttatggctcatgcatgcatcaaaaaagatgtgagcttgatcaaaaacaaaaaatatttcactcgacaggagtatttatattgcgcccgttacgtgggcttcgactgtaaatcagaaaggagaaaacacct

SEQ ID NO: 174 - DNA, 305 bp, Unknown
  source: /note="Description of Unknown: FNR responsive promoter"
gtcagcataacaccctgacctctcattaattgttcatgccgggcggcactatcgtcgtccggccttttcctctcttactctgctacgtacatctatttctataaatccgttcaatttgtctgttttttgcacaaacatgaaatatcagacaattccgtgacttaagaaaatttatacaaatcagcaatataccccttaaggagtatataaaggtgaatttgatttacatcaataagcggggttgctgaatcgttaaggatccctctagaaataattttgtttaactttaagaaggagatatacat

SEQ ID NO: 175 - DNA, 180 bp, Unknown
  source: /note="Description of Unknown: FNR responsive promoter"
catttcctctcatcccatccggggtgagagtcttttcccccgacttatggctcatgcatgcatcaaaaaagatgtgagcttgatcaaaaacaaaaaatatttcactcgacaggagtatttatattgcgcccggatccctctagaaataattttgtttaactttaagaaggagatatacat

SEQ ID NO: 176 - DNA, 199 bp, Unknown
  source: /note="Description of Unknown: FNR responsive promoter"
agttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttggatccctctagaaataattttgtttaactttaagaaggagatatacat

SEQ ID NO: 177 - DNA, 117 bp, Unknown
  source: /note="Description of Unknown: FNR responsive promoter"
atccccatcactcttgatggagatcaattccccaagctgctagagcgttaccttgcccttaaacattagcaatgtcgatttatcagagggccgacaggctcccacaggagaaaaccg

SEQ ID NO: 178 - DNA, 108 bp, Unknown
  source: /note="Description of Unknown: FNR responsive promoter"
ctcttgatcgttatcaattcccacgctgtttcagagcgttaccttgcccttaaacattagcaatgtcgatttatcagagggccgacaggctcccacaggagaaaaccg

SEQ ID NO: 179 - DNA, 290 bp, Unknown; identical to SEQ ID NO: 172
  source: /note="Description of Unknown: FNR responsive promoter"

SEQ ID NO: 180 - DNA, 433 bp, Unknown
  source: /note="Description of Unknown: FNR responsive promoter"
cggcccgatcgttgaacatagcggtccgcaggcggcactgcttacagcaaacggtctgtacgctgtcgtctttgtgatgtgcttcctgttaggtttcgtcagccgtcaccgtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtaggcggtaatagaaaagaaatcgaggcaaaaatgtttgtttaactttaagaaggagatatacat

SEQ ID NO: 181 - DNA, 290 bp, Unknown
  source: /note="Description of Unknown: FNR responsive promoter"
gtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtaggcggtaatagaaaagaaatcgaggcaaaa

SEQ ID NO: 182 - DNA, 173 bp, Unknown; identical to SEQ ID NO: 173
  source: /note="Description of Unknown: FNR responsive promoter"

SEQ ID NO: 183 - DNA, 305 bp, Unknown; identical to SEQ ID NO: 174
  source: /note="Description of Unknown: FNR responsive promoter"

SEQ ID NO: 184 - DNA, 180 bp, Unknown; identical to SEQ ID NO: 175
  source: /note="Description of Unknown: FNR responsive promoter"

SEQ ID NO: 185 - DNA, 199 bp, Unknown; identical to SEQ ID NO: 176
  source: /note="Description of Unknown: FNR responsive promoter"

SEQ ID NO: 186 - DNA, 207 bp, Unknown
  source: /note="Description of Unknown: FNR responsive promoter"
agttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatccaaagtgaactctagaaataattttgtttaactttaagaaggagatatacat

SEQ ID NO: 187 - DNA, 390 bp, Unknown
  source: /note="Description of Unknown: FNR responsive promoter"
tcgtctttgtgatgtgcttcctgttaggtttcgtcagccgtcaccgtcagcataacaccctgacctctcattaattgctcatgccggacggcactatcgtcgtccggccttttcctctcttcccccgctacgtgcatctatttctataaacccgctcattttgtctattttttgcacaaacatgaaatatcagacaattccgtgacttaagaaaatttatacaaatcagcaatatacccattaaggagtatataaaggtgaatttgatttacatcaataagcggggttgctgaatcgttaaggtagaaatgtgatctagttcacatttgcggtaatagaaaagaaatcgaggcaaaaatgtttgtttaactttaagaaggagatatacat

SEQ ID NO: 188 - DNA, 200 bp, Unknown
  source: /note="Description of Unknown: FNR responsive promoter"
agttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcaaatgtgatctagttcacattttttgtttaactttaagaaggagatatacat

SEQ ID NO: 189 - DNA, 355 bp, Artificial Sequence
  source: /note="Description of Artificial Sequence: Synthetic polynucleotide"
tgtggcttttatgaaaatcacacagtgatcacaaattttaaacagagcacaaaatgctgcctcgaaatgagggcgggaaaataaggttatcagccttgttttctccctcattacttgaaggatatgaagctaaaacccttttttataaagcatttgtccgaattcggacataatcaaaaaagcttaattaagatcaatttgatctacatctctttaaccaacaatatgtaagatctcaactatcgcatccgtggattaattcaattataacttctctctaacgctgtgtatcgtaacggtaacactgtagaggggagcacattgatgcgaattcattaaagaggagaaaggtacc

SEQ ID NO: 190 - DNA, 228 bp, Artificial Sequence
  source: /note="Description of Artificial Sequence: Synthetic polynucleotide"
ttccgaaaattcctggcgagcagataaataagaattgttcttatcaatatatctaactcattgaatctttattagttttgtttttcacgcttgttaccactattagtgtgataggaacagccagaatagcggaacacatagccggtgctatacttaatctcgttaattactgggacataacatcaagaggatatgaaattcgaattcattaaagaggagaaaggtacc

SEQ ID NO: 191 - DNA, 334 bp, Artificial Sequence
  source: /note="Description of Artificial Sequence: Synthetic polynucleotide"
gcttagatcaggtgattgccctttgtttatgagggtgttgtaatccatgtcgttgttgcatttgtaagggcaacacctcagcctgcaggcaggcactgaagataccaaagggtagttcagattacacggtcacctggaaagggggccattttactttttatcgccgctggcggtgcaaagttcacaaagttgtcttacgaaggttgtaaggtaaaacttatcgatttgataatggaaacgcattagccgaatcggcaaaaattggttaccttacatctcatcgaaaacacggaggaagtatagatgcgaattcattaaagaggagaaaggtacc

SEQ ID NO: 192 - DNA, 134 bp, Artificial Sequence
  source: /note="Description of Artificial Sequence: Synthetic polynucleotide"
ctcgagttcattatccatcctccatcgccacgatagttcatggcgataggtagaatagcaatgaacgattatccctatcaagcattctgactgataattgctcacacgaattcattaaagaggagaaaggtacc

SEQ ID NO: 193 - DNA, 1921 bp, Artificial Sequence
  source: /note="Description of Artificial Sequence: Synthetic polynucleotide"
ttacccgtctggattttcagtacgcgcttttaaacgacgccacagcgtggtacggctgatccccaaataacgtgcggcggcgcgcttatcgccattaaagcgtgcgagcacctcctgcaatggaagcgcttctgctgacgagggcgtgatttctgctgtggtccccaccagttcaggtaataattgccgcataaattgtctgtccagtgttggtgcgggatcgacgcttaaaaaaagcgccaggcgttccatcatattccgcagttcgcgaatattaccgggccaatgatagttcagtagaagcggctgacactgcgtcagcccatgacgcaccgattcggtaaaagggatctccatcgcggccagcgattgttttaaaaagttttccgccagaggcagaatatcaggctgtcgctcgcgcaaggggggaagcggcagacgcagaatgctcaaacggtaaaacagatcggtacgaaaacgtccttgcgttatctcccgatccagatcgcaatgcgtggcgctgatcacccggacatctaccgggatcggctgatgcccgccaacgcgggtgacggctttttcctccagtacgcgtagaaggcgggtttgtaacggcagcggcatttcgccaatttcgtcaagaaacagcgtgccgccgtgggcgacctcaaacagccccgcacgtccacctcgtcttgagccggtaaacgctccctcctcatagccaaacagttcagcctccagcaacgactcggtaatcgcgccgcaattaacggcgacaaagggcggagaaggcttgttctgacggtggggctgacggttaaacaacgcctgatgaatcgcttgcgccgccagctctttcccggtccctgtttccccctgaatcagcactgccgcgcgggaacgggcatagagtgtaatcgtatggcgaacctgctccatttgtggtgaatcgccgaggatatcgctcagcgcataacgggtctgtaatcccttgctggaggtatgctggctatactgacgccgtgtcaggcgggtcatatccagcgcatcatggaaagcctgacgtacggtggccgctgaataaataaagatggcggtcattcctgcctcttccgccaggtcggtaattagtcctgccccaattacagcctcaatgccgttagctttgagctcgttaatttgcccgcgagcatcctcttcagtgatatagcttcgctgttcaagacggaggtgaaacgttttctgaaaggcgaccagagccggaatggtctcctgataggtcacgattcccattgaggaagtcagctttcccgcttttgccagagcctgtaatacatcgaatccgctgggtttgatgaggatgacaggtaccgacagtcggctttttaaataagcgccgttggaacctgccgcgataatcgcgtcgcagcgttcggttgccagttttttgcgaatgtaggctactgccttttcaaaaccgagctgaataggcgtgatcgtcgccagatgatcaaactccaggctgatatcccgaaatagttcgaacaggcgcgttaccgagaccgtccagatcaccggtttatcgctattatcgcgcgaagcgctatgcacagtaaccatcgtcgtagattcatgtttaaggaacgaattcttgttttatagatgtttcgttaatgttgcaatgaaacacaggcctccgtttcatgaaacgttagctgactcgtttttcttgtgactcgtctgtcagtattaaaaaagatttttcatttaactgattgtttttaaattgaattttatttaatggtttctcggtttttgggtctggcatatcccttgctttaatgagtgcatcttaattaacaattcaataacaagagggctgaatagtaatttcaacaaaataacgagcattcgaatg

SEQ ID NO: 194 - DNA, 60 bp, Artificial Sequence
  source: /note="Description of Artificial Sequence: Synthetic primer"
tagaactgatgcaaaaagtgctcgacgaaggcacacagatgtgtaggctggagctgcttc

SEQ ID NO: 195 - DNA, 60 bp, Artificial Sequence
  source: /note="Description of Artificial Sequence: Synthetic primer"
gtttcgtaattagatagccaccggcgctttaatgcccggacatatgaatatcctccttag

SEQ ID NO: 196 - DNA, 52 bp, Artificial Sequence
  source: /note="Description of Artificial Sequence: Synthetic primer"
caacacgtttcctgaggaaccatgaaacagtatttagaactgatgcaaaaag

SEQ ID NO: 197 - DNA, 46 bp, Artificial Sequence
  source: /note="Description of Artificial Sequence: Synthetic primer"
cgcacactggcgtcggctctggcaggatgtttcgtaattagatagc

SEQ ID NO: 198 - DNA, 36 bp, Artificial Sequence
  source: /note="Description of Artificial Sequence: Synthetic primer"
atatcgtcgcagcccacagcaacacgtttcctgagg

SEQ ID NO: 199 - DNA, 47 bp, Artificial Sequence
  source: /note="Description of Artificial Sequence: Synthetic primer"
aagaatttaacggagggcaaaaaaaaccgacgcacactggcgtcggc

SEQ ID NO: 200 - DNA, 8575 bp, Artificial Sequence
  source: /note="Description of Artificial Sequence: Synthetic polynucleotide"
ttattatcgcaccgcaatcgggattttcgattcataaagcaggtcgtaggtcggcttgttgagcaggtcttgcagcgtgaaaccgtccagatacgtgaaaaacgacttcattgcaccgccgagtatgcccgtcagccggcaggacggcgtaatcaggcattcgttgttcgggcccatacactcgaccagctgcatcggttcgaggtggcggacgaccgcgccgatattgatgcgttcgggcggcgcggccagcctcagcccgccgcctttcccgcgtacgctgtgcaagaacccgcctttgaccagcgcggtaaccactttcatcaaatggcttttggaaatgccgtaggtcgaggcgatggtggcgatattgaccagcgcgtcgtcgttgacggcggtgtagatgaggacgcgcagcccgtagtcggtatgttgggtcagatacatacaacctccttagtacatgcaaaattatttctagagcaacatacgagccggaagcataaagtgtaaagcctggggtgcctaatgagttgagttgaggaattataacaggaagaaatattcctcatacgcttgtaattcctctatggttgttgacaattaatcatcggctcgtataatgtataacattcatattttgtgaattttaaactctagaaataattttgtttaactttaagaaggagatatacatatggatttaaattctaaaaaatatcagatgcttaaagagctatatgtaagcttcgctgaaaatgaagttaaacctttagcaacagaacttgatgaagaagaaagatttccttatgaaacagtggaaaaaatggcaaaagcaggaatgatgggtataccatatccaaaagaatatggtggagaaggtggagacactgtaggatatataatggcagttgaagaattgtctagagtttgtggtactacaggagttatattatcagctcatacatctcttggctcatggcctatatatcaatatggtaatgaagaacaaaaacaaaaattcttaagaccactagcaagtggagaaaaattaggagcatttggtcttactgagcctaatgctggtacagatgcgtctggccaacaaacaactgctgttttagacggggatgaatacatacttaatggctcaaaaatatttataacaaacgcaatagctggtgacatatatgtagtaatggcaatgactgataaatctaaggggaacaaaggaatatcagcatttatagttgaaaaaggaactcctgggtttagctttggagttaaagaaaagaaaatgggtataagaggttcagctacgagtgaattaatatttgaggattgcagaatacctaaagaaaatttacttggaaaagaaggtcaaggatttaagatagcaatgtctactcttgatggtggtagaattggtatagctgcacaagctttaggtttagcacaaggtgctcttgatgaaactgttaaatatgtaaaagaaagagtacaatttggtagaccattatcaaaattccaaaatacacaattccaattagctgatatggaagttaaggtacaagcggctagacaccttgtatatcaagcagctataaataaagacttaggaaaaccttatggagtagaagcagcaatggcaaaattatttgcagctgaaacagctatggaagttactacaaaagctgtacaacttcatggaggatatggatacactcgtgactatccagtagaaagaatgatgagagatgctaagataactgaaatatatgaaggaactagtgaagttcaaagaatggttatttcaggaaaactattaaaatagtaagaaggagatatacatatggaggaaggatttatgaatatagtcgtttgtataaaacaagttccagatacaacagaagttaaactagatcctaatacaggtactttaattagagatggagtaccaagtataataaaccctgatgataaagcaggtttagaagaagctataaaattaaaagaagaaatgggtgctcatgtaactgttataacaatgggacctcctcaagcagatatggctttaaaagaagctttagcaatgggtgcagatagaggtatattattaacagatagagcatttgcgggtgctgatacttgggcaacttcatcagcattagcaggagcattaaaaaatatagattttgatattataatagctggaagacaggcgatagatggagatactgcacaagttggacctcaaatagctgaacatttaaatcttccatcaataacatatgctgaagaaataaaaactgaaggtgaatatgtattagtaaaaagacaatttgaagattgttgccatgacttaaaagttaaaatgccatgccttataacaactcttaaagatatgaacacaccaagatacatgaaagttggaagaatatatgatgctttcgaaaatgatgtagtagaaacatggactgtaaaagatatagaagttgacccttctaatttaggtcttaaaggttctccaactagtgtatttaaatcatttacaaaatcagttaaaccagctggtacaatatacaatgaagatgcgaaaacatcagctggaattatcatagataaattaaaagagaagtatatcatataataagaaggagatatacatatgggtaacgttttagtagtaatagaacaaagagaaaatgtaattcaaactgtttctttagaattactaggaaaggctacagaaatagcaaaagattatgatacaaaagtttctgcattacttttaggtagtaaggtagaaggtttaatagatacattagcacactatggtgcagatgaggtaatagtagtagatgatgaagctttagcagtgtatacaactgaaccatatacaaaagcagcttatgaagcaataaaagcagctgaccctatagttgtattatttggtgcaacttcaataggtagagatttagcgcctagagtttctgctagaatacatacaggtcttactgctgactgtacaggtcttgcagtagctgaagatacaaaattattattaatgacaagacctgcctttggtggaaatataatggcaacaatagtttgtaaagatttcagacctcaaatgtctacagttagaccaggggttatgaagaaaaatgaacctgatgaaactaaagaagctgtaattaaccgtttcaaggtagaatttaatgatgctgataaattagttcaagttgtacaagtaataaaagaagctaaaaaacaagttaaaatagaagatgctaagatattagtttctgctggacgtggaatgggtggaaaagaaaacttagacatactttatgaattagctgaaattataggtggagaagtttctggttctcgtgccactatagatgcaggttggttagataaagcaagacaagttggtcaaactggtaaaactgtaagaccagacctttatatagcatgtggtatatctggagcaatacaacatatagctggtatggaagatgctgagtttatagttgctataaataaaaatccagaagctccaatatttaaatatgctgatgttggtatagttggagatgttcataaagtgcttccagaacttatcagtcagttaagtgttgcaaaagaaaaaggtgaagttttagctaactaataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 201 - DNA, 6787 bp, Artificial Sequence
  source: /note="Description of Artificial Sequence: Synthetic polynucleotide"
ttattatcgcaccgcaatcgggattttcgattcataaagcaggtcgtaggtcggcttgttgagcaggtcttgcagcgtgaaaccgtccagatacgtgaaaaacgacttcattgcaccgccgagtatgcccgtcagccggcaggacggcgtaatcaggcattcgttgttcgggcccatacactcgaccagctgcatcggttcgaggtggcggacgaccgcgccgatattgatgcgttcgggcggcgcggccagcctcagcccgccgcctttcccgcgtacgctgtgcaagaacccgcctttgaccagcgcggtaaccactttcatcaaatggcttttggaaatgccgtaggtcgaggcgatggtggcgatattgaccagcgcgtcgtcgttgacggcggtgtagatgaggacgcgcagcccgtagtcggtatgttgggtcagatacatacaacctccttagtacatgcaaaattatttctagagcaacatacgagccggaagcataaagtgtaaagcctggggtgcctaatgagttgagttgaggaattataacaggaagaaatattcctcatacgcttgtaattcctctatggttgttgacaattaatcatcggctcgtataatgtataacattcatattttgtgaattttaaactctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 202 - DNA, 8012 bp, Artificial Sequence
  source: /note="Description of Artificial Sequence: Synthetic polynucleotide"
ctcgagttcattatccatcctccatcgccacgatagttcatggcgataggtagaatagcaatgaacgattatccctatcaagcattctgactgataattgctcacacgaattcattaaagaggagaaaggtaccatggatttaaattctaaaaaatatcagatgcttaaagagctatatgtaagcttcgctgaaaatgaagttaaacctttagcaacagaacttgatgaagaagaaagatttccttatgaaacagtggaaaaaatggcaaaagcaggaatgatgggtataccatatccaaaagaatatggtggagaaggtggagacactgtaggatatataatggcagttgaagaattgtctagagtttgtggtactacaggagttatattatcagctcatacatctcttggctcatggcctatatatcaatatggtaatgaagaacaaaaacaaaaattcttaagaccactagcaagtggagaaaaattaggagcatttggtcttactgagcctaatgctggtacagatgcgtctggccaacaaacaactgctgttttagacggggatgaatacatacttaatggctcaaaaatatttataacaaacgcaatagctggtgacatatatgtagtaatggcaatgactgataaatctaaggggaacaaaggaatatcagcatttatagttgaaaaaggaactcctgggtttagctttggagttaaagaaaagaaaatgggtataagaggttcagctacgagtgaattaatatttgaggattgcagaatacctaaagaaaatttacttggaaaagaaggtcaaggatttaagatagcaatgtctactcttgatggtggtagaattggtatagctgcacaagctttaggtttagcacaaggtgctcttgatgaaactgttaaatatgtaaaagaaagagtacaatttggtagaccattatcaaaattccaaaatacacaattccaattagctgatatggaagttaaggtacaagcggctagacaccttgtatatcaagcagctataaataaagacttaggaaaaccttatggagtagaagcagcaatggcaaaattatttgcagctgaaacagctatggaagttactacaaaagctgtacaacttcatggaggatatggatacactcgtgactatccagtagaaagaatgatgagagatgctaagataactgaaatatatgaaggaactagtgaagttcaaagaatggttatttcaggaaaactattaaaatagtaagaaggagatatacatatggaggaaggatttatgaatatagtcgtttgtataaaacaagttccagatacaacagaagttaaactagatcctaatacaggtactttaattagagatggagtaccaagtataataaaccctgatgataaagcaggtttagaagaagctataaaattaaaagaagaaatgggtgctcatgtaactgttataacaatgggacctcctcaagcagatatggctttaaaagaagctttagcaatgggtgcagatagaggtatattattaacagatagagcatttgcgggtgctgatacttgggcaacttcatcagcattagcaggagcattaaaaaatatagattttgatattataatagctggaagacaggcgatagatggagatactgcacaagttggacctcaaatagctgaacatttaaatcttccatcaataacatatgctgaagaaataaaaactgaaggtgaatatgtattagtaaaaagacaatttgaagattgttgccatgacttaaaagttaaaatgccatgccttataacaactcttaaagatatgaacacaccaagatacatgaaagttggaagaatatatgatgctttcgaaaatgatgtagtagaaacatggactgtaaaagatatagaagttgacccttctaatttaggtcttaaaggttctccaactagtgtatttaaatcatttacaaaatcagttaaaccagctggtacaatatacaatgaagatgcgaaaacatcagctggaattatcatagataaattaaaagagaagtatatcatataataagaaggagatatacatatgggtaacgttttagtagtaatagaacaaagagaaaatgtaattcaaactgtttctttagaattactaggaaaggctacagaaatagcaaaagattatgatacaaaagtttctgcattacttttaggtagtaaggtagaaggtttaatagatacattagcacactatggtgcagatgaggtaatagtagtagatgatgaagctttagcagtgtatacaactgaaccatatacaaaagcagcttatgaagcaataaaagcagctgaccctatagttgtattatttggtgcaacttcaataggtagagatttagcgcctagagtttctgctagaatacatacaggtcttactgctgactgtacaggtcttgcagtagctgaagatacaaaattattattaatgacaagacctgcctttggtggaaatataatggcaacaatagtttgtaaagatttcagacctcaaatgtctacagttagaccaggggttatgaagaaaaatgaacctgatgaaactaaagaagctgtaattaaccgtttcaaggtagaatttaatgatgctgataaattagttcaagttgtacaagtaataaaagaagctaaaaaacaagttaaaatagaagatgctaagatattagtttctgctggacgtggaatgggtggaaaagaaaacttagacatactttatgaattagctgaaattataggtggagaagtttctggttctcgtgccactatagatgcaggttggttagataaagcaagacaagttggtcaaactggtaaaactgtaagaccagacctttatatagcatgtggtatatctggagcaatacaacatatagctggtatggaagatgctgagtttatagttgctataaataaaaatccagaagctccaatatttaaatatgctgatgttggtatagttggagatgttcataaagtgcttccagaacttatcagtcagttaagtgttgcaaaagaaaaaggtgaagttttagctaactaataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 203 - DNA, 6224 bp, Artificial Sequence
  source: /note="Description of Artificial Sequence: Synthetic polynucleotide"
ctcgagttcattatccatcctccatcgccacgatagttcatggcgataggtagaatagcaatgaacgattatccctatcaagcattctgactgataattgctcacacgaattcattaaagaggagaaaggtaccatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 204 - DNA, 3118 bp, Artificial Sequence
  source: /note="Description of Artificial Sequence: Synthetic polynucleotide"
ctcgagatgctagcaattgtgagcggataacaattgacattgtgagcggataacaagatactgagcacatcagcaggacgcactgaccttaattaaaagaattcattaaagaggagaaaggtaccatgaatattcgtgatcttgagtacctggtggcattggctgaacaccgccattttcggcgtgcggcagattcctgccacgttagccagccgacgcttagcgggcaaattcgtaagctggaagatgagctgggcgtgatgttgctggagcggaccagccgtaaagtgttgttcacccaggcgggaatgctgctggtggatcaggcgcgtaccgtgctgcgtgaggtgaaagtccttaaagagatggcaagccagcagggcgagacgatgtccggaccgctgcacattggtttgattcccacagttggaccgtacctgctaccgcatattatccctatgctgcaccagacctttccaaagctggaaatgtatctgcatgaagcacagacccaccagttactggcgcaactggacagcggcaaactcgattgcgtgatcctcgcgctggtgaaagagagcgaagcattcattgaagtgccgttgtttgatgagccaatgttgctggctatctatgaagatcacccgtgggcgaaccgcgaatgcgtaccgatggccgatctggcaggggaaaaactgctgatgctggaagatggtcactgtttgcgcgatcaggcaatgggtttctgttttgaagccggggcggatgaagatacacacttccgcgcgaccagcctggaaactctgcgcaacatggtggcggcaggtagcgggatcactttactgccagcgctggctgtgccgccggagcgcaaacgcgatggggttgtttatctgccgtgcattaagccggaaccacgccgcactattggcctggtttatcgtcctggctcaccgctgcgcagccgctatgagcagctggcagaggccatccgcgcaagaatggatggccatttcgataaagttttaaaacaggcggtttaaggatcccatggtacgcgtgctagaggcatcaaataaaacgaaaggctcagtcgaaagactgggcctttcgttttatctgttgtttgtcggtgaacgctctcctgagtaggacaaatccgccgccctagacctaggggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgttactagtgcttggattctcaccaataaaaaacgcccggcggcaaccgagcgttctgaacaaatccagatggagttctgaggtcattactggatctatcaacaggagtccaagcgagctctcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccgacgtctaagaaaccattattatcatgacattaacctataaaaataggcgtatcacgaggccctttcgtcttcac

SEQ ID NO: 205 - DNA, 8650 bp, Artificial Sequence
  source: /note="Description of Artificial Sequence: Synthetic polynucleotide"
gtaaaacgacggccagtgaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatggatttaaattctaaaaaatatcagatgcttaaagagctatatgtaagcttcgctgaaaatgaagttaaacctttagcaacagaacttgatgaagaagaaagatttccttatgaaacagtggaaaaaatggcaaaagcaggaatgatgggtataccatatccaaaagaatatggtggagaaggtggagacactgtaggatatataatggcagttgaagaattgtctagagtttgtggtactacaggagttatattatcagctcatacatctcttggctcatggcctatatatcaatatggtaatgaagaacaaaaacaaaaattcttaagaccactagcaagtggagaaaaattaggagcatttggtcttactgagcctaatgctggtacagatgcgtctggccaacaaacaactgctgttttagacggggatgaatacatacttaatggctcaaaaatatttataacaaacgcaatagctggtgacatatatgtagtaatggcaatgactgataaatctaaggggaacaaaggaatatcagcatttatagttgaaaaaggaactcctgggtttagctttggagttaaagaaaagaaaatgggtataagaggttcagctacgagtgaattaatatttgaggattgcagaatacctaaagaaaatttacttggaaaagaaggtcaaggatttaagatagcaatgtctactcttgatggtggtagaattggtatagctgcacaagctttaggtttagcacaaggtgctcttgatgaaactgttaaatatgtaaaagaaagagtacaatttggtagaccattatcaaaattccaaaatacacaattccaattagctgatatggaagttaaggtacaagcggctagacaccttgtatatcaagcagctataaataaagacttaggaaaaccttatggagtagaagcagcaatggcaaaattatttgcagctgaaacagctatggaagttactacaaaagctgtacaacttcatggaggatatggatacactcgtgactatccagtagaaagaatgatgagagatgctaagataactgaaatatatgaaggaactagtgaagttcaaagaatggttatttcaggaaaactattaaaatagtaagaaggagatatacatatggaggaaggatttatgaatatagtcgtttgtataaaacaagttccagatacaacagaagttaaactagatcctaatacaggtactttaattagagatggagtaccaagtataataaaccctgatgataaagcaggtttagaagaagctataaaattaaaagaagaaatgggtgctcatgtaactgttataacaatgggacctcctcaagcagatatggctttaaaagaagctttagcaatgggtgcagatagaggtatattattaacagatagagcatttgcgggtgctgatacttgggcaacttcatcagcattagcaggagcattaaaaaatatagattttgatattataatagctggaagacaggcgatagatggagatactgcacaagttggacctcaaatagctgaacatttaaatcttccatcaataacatatgctgaagaaataaaaactgaaggtgaatatgtattagtaaaaagacaatttgaagattgttgccatgacttaaaagttaaaatgccatgccttataacaactcttaaagatatgaacacaccaagatacatgaaagttggaagaatatatgatgctttcgaaaatgatgtagtagaaacatggactgtaaaagatatagaagttgacccttctaatttaggtcttaaaggttctccaactagtgtatttaaatcatttacaaaatcagttaaaccagctggtacaatatacaatgaagatgcgaaaacatcagctggaattatcatagataaattaaaagagaagtatatcatataataagaaggagatatacatatgggtaacgttttagtagtaatagaacaaagagaaaatgtaattcaaactgtttctttagaattactaggaaaggctacagaaatagcaaaagattatgatacaaaagtttctgcattacttttaggtagtaaggtagaaggtttaatagatacattagcacactatggtgcagatgaggtaatagtagtagatgatgaagctttagcagtgtatacaactgaaccatatacaaaagcagcttatgaagcaataaaagcagctgaccctatagttgtattatttggtgcaacttcaataggtagagatttagcgcctagagtttctgctagaatacatacaggtcttactgctgactgtacaggtcttgcagtagctgaagatacaaaattattattaatgacaagacctgcctttggtggaaatataatggcaacaatagtttgtaaagatttcagacctcaaatgtctacagttagaccaggggttatgaagaaaaatgaacctgatgaaactaaagaagctgtaattaaccgtttcaaggtagaatttaatgatgctgataaattagttcaagttgtacaagtaataaaagaagctaaaaaacaagttaaaatagaagatgctaagatattagtttctgctggacgtggaatgggtggaaaagaaaacttagacatactttatgaattagctgaaattataggtggagaagtttctggttctcgtgccactatagatgcaggttggttagataaagcaagacaagttggtcaaactggtaaaactgtaagaccagacctttatatagcatgtggtatatctggagcaatacaacatatagctggtatggaagatgctgagtttatagttgctataaataaaaatccagaagctccaatatttaaatatgctgatgttggtatagttggagatgttcataaagtgcttccagaacttatcagtcagttaagtgttgcaaaagaaaaaggtgaagttttagctaactaataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 206 - DNA, 6862 bp, Artificial Sequence
  source: /note="Description of Artificial Sequence: Synthetic polynucleotide"
gtaaaacgacggccagtgaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 207 - DNA, 5644 bp, Artificial Sequence
  source: /note="Description of Artificial Sequence: Synthetic polynucleotide"
ttattatcgcaccgcaatcgggattttcgattcataaagcaggtcgtaggtcggcttgttgagcaggtcttgcagcgtgaaaccgtccagatacgtgaaaaacgacttcattgcaccgccgagtatgcccgtcagccggcaggacggcgtaatcaggcattcgttgttcgggcccatacactcgaccagctgcatcggttcgaggtggcggacgaccgcgccgatattgatgcgttcgggcggcgcggccagcctcagcccgccgcctttcccgcgtacgctgtgcaagaacccgcctttgaccagcgcggtaaccactttcatcaaatggcttttggaaatgccgtaggtcgaggcgatggtggcgatattgaccagcgcgtcgtcgttgacggcggtgtagatgaggacgcgcagcccgtagtcggtatgttgggtcagatacatacaacctccttagtacatgcaaaattatttctagagcaacatacgagccggaagcataaagtgtaaagcctggggtgcctaatgagttgagttgaggaattataacaggaagaaatattcctcatacgcttgtaattcctctatggttgttgacaattaatcatcggctcgtataatgtataacattcatattttgtgaattttaaactctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagtcaggcgctaaaaaatttactgacattgttaaatctggaaaaaattgaggaaggactctttcgcggccagagtgaagatttaggtttacgccaggtgtttggcggccaggtcgtgggtcaggccttgtatgctgcaaaagagaccgtccctgaagagcggctggtacattcgtttcacagctactttcttcgccctggcgatagtaagaagccgattatttatgatgtcgaaacgctgcgtgacggtaacagcttcagcgcccgccgggttgctgctattcaaaacggcaaaccgattttttatatgactgcctctttccaggcaccagaagcgggtttcgaacatcaaaaaacaatgccgtccgcgccagcgcctgatggcctcccttcggaaacgcaaatcgcccaatcgctggcgcacctgctgccgccagtgctgaaagataaattcatctgcgatcgtccgctggaagtccgtccggtggagtttcataacccactgaaaggtcacgtcgcagaaccacatcgtcaggtgtggatccgcgcaaatggtagcgtgccggatgacctgcgcgttcatcagtatctgctcggttacgcttctgatcttaacttcctgccggtagctctacagccgcacggcatcggttttctcgaaccggggattcagattgccaccattgaccattccatgtggttccatcgcccgtttaatttgaatgaatggctgctgtatagcgtggagagcacctcggcgtccagcgcacgtggctttgtgcgcggtgagttttatacccaagacggcgtactggttgcctcgaccgttcaggaaggggtgatgcgtaatcacaattaa

SEQ ID NO: 208 - DNA, 5719 bp, Artificial Sequence
  source: /note="Description of Artificial Sequence: Synthetic polynucleotide"
gtaaaacgacggccagtgaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagtcaggcgctaaaaaatttactgacattgttaaatctggaaaaaattgaggaaggactctttcgcggccagagtgaagatttaggtttacgccaggtgtttggcggccaggtcgtgggtcaggccttgtatgctgcaaaagagaccgtccctgaagagcggctggtacattcgtttcacagctactttcttcgccctggcgatagtaagaagccgattatttatgatgtcgaaacgctgcgtgacggtaacagcttcagcgcccgccgggttgctgctattcaaaacggcaaaccgattttttatatgactgcctctttccaggcaccagaagcgggtttcgaacatcaaaaaacaatgccgtccgcgccagcgcctgatggcctcccttcggaaacgcaaatcgcccaatcgctggcgcacctgctgccgccagtgctgaaagataaattcatctgcgatcgtccgctggaagtccgtccggtggagtttcataacccactgaaaggtcacgtcgcagaaccacatcgtcaggtgtggatccgcgcaaatggtagcgtgccggatgacctgcgcgttcatcagtatctgctcggttacgcttctgatcttaacttcctgccggtagctctacagccgcacggcatcggttttctcgaaccggggattcagattgccaccattgaccattccatgtggttccatcgcccgtttaatttgaatgaatggctgctgtatagcgtggagagcacctcggcgtccagcgcacgtggctttgtgcgcggtgagttttatacccaagacggcgtactggttgcctcgaccgttcaggaaggggtgatgcgtaatcacaattaa

SEQ ID NO: 209 - DNA, 180 bp, Artificial Sequence; identical to SEQ ID NO: 175
  source: /note="Description of Artificial Sequence: Synthetic polynucleotide"

SEQ ID NO: 210 - DNA, 23 bp, Artificial Sequence
  source: /note="Description of Artificial Sequence: Synthetic oligonucleotide"
tttgtttaactttaagaaggaga

SEQ ID NO: 211 - DNA, 18 bp, Artificial Sequence
  source: /note="Description of Artificial Sequence: Synthetic oligonucleotide"
taagaaggagatatacat

SEQ ID NO: 212 - DNA, 6270 bp, Artificial Sequence
  source: /note="Description of Artificial Sequence: Synthetic polynucleotide"
catttcctctcatcccatccggggtgagagtcttttcccccgacttatggctcatgcatgcatcaaaaaagatgtgagcttgatcaaaaacaaaaaatatttcactcgacaggagtatttatattgcgcccggatccctctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaataa

SEQ ID NO: 213 - DNA, 5160 bp, Artificial Sequence
  source: /note="Description of Artificial Sequence: Synthetic polynucleotide"
ggtaccagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatccaaagtgaactctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagtcaggcgctaaaaaatttactgacattgttaaatctggaaaaaattgaggaaggactctttcgcggccagagtgaagatttaggtttacgccaggtgtttggcggccaggtcgtgggtcaggccttgtatgctgcaaaagagaccgtccctgaagagcggctggtacattcgtttcacagctactttcttcgccctggcgatagtaagaagccgattatttatgatgtcgaaacgctgcgtgacggtaacagcttcagcgcccgccgggttgctgctattcaaaacggcaaaccgattttttatatgactgcctctttccaggcaccagaagcgggtttcgaacatcaaaaaacaatgccgtccgcgccagcgcctgatggcctcccttcggaaacgcaaatcgcccaatcgctggcgcacctgctgccgccagtgctgaaagataaattcatctgcgatcgtccgctggaagtccgtccggtggagtttcataacccactgaaaggtcacgtcgcagaaccacatcgtcaggtgtggatccgcgcaaatggtagcgtgccggatgacctgcgcgttcatcagtatctgctcggttacgcttctgatcttaacttcctgccggtagctctacagccgcacggcatcggttttctcgaaccggggattcagattgccaccattgaccattccatgtggttccatcgcccgtttaatttgaatgaatggctgctgtatagcgtggagagcacctcggcgtccagcgcacgtggctttgtgcgcggtgagttttatacccaagacggcgtactggttgcctcgaccgttcaggaaggggtgatgcgtaatcacaattaa

SEQ ID NO: 214 - DNA, 6300 bp, Artificial Sequence
  source: /note="Description of Artificial Sequence: Synthetic polynucleotide"
ggtaccagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatccaaagtgaactctagaaataattttgtttaactttaagaaggagatatacatatgatcgtaaaacctatggtacgcaacaatatctgcctgaacgcccatcctcagggctgcaagaagggagtggaagatcagattgaatataccaagaaacgcattaccgcagaagtcaaagctggcgcaaaagctccaaaaaacgttctggtgcttggctgctcaaatggttacggcctggcgagccgcattactgctgcgttcggatacggggctgcgaccatcggcgtgtcctttgaaaaagcgggttcagaaaccaaatatggtacaccgggatggtacaataatttggcatttgatgaagcggcaaaacgcgagggtctttatagcgtgacgatcgacggcgatgcgttttcagacgagatcaaggcccaggtaattgaggaagccaaaaaaaaaggtatcaaatttgatctgatcgtatacagcttggccagcccagtacgtactgatcctgatacaggtatcatgcacaaaagcgttttgaaaccctttggaaaaacgttcacaggcaaaacagtagatccgtttactggcgagctgaaggaaatctccgcggaaccagcaaatgacgaggaagcagccgccactgttaaagttatggggggtgaagattgggaacgttggattaagcagctgtcgaaggaaggcctcttagaagaaggctgtattaccttggcctatagttatattggccctgaagctacccaagctttgtaccgtaaaggcacaatcggcaaggccaaagaacacctggaggccacagcacaccgtctcaacaaagagaacccgtcaatccgtgccttcgtgagcgtgaataaaggcctggtaacccgcgcaagcgccgtaatcccggtaatccctctgtatctcgccagcttgttcaaagtaatgaaagagaagggcaatcatgaaggttgtattgaacagatcacgcgtctgtacgccgagcgcctgtaccgtaaagatggtacaattccagttgatgaggaaaatcgcattcgcattgatgattgggagttagaagaagacgtccagaaagcggtatccgcgttgatggagaaagtcacgggtgaaaacgcagaatctctcactgacttagcggggtaccgccatgatttcttagctagtaacggctttgatgtagaaggtattaattatgaagcggaagttgaacgcttcgaccgtatctgataagaaggagatatacatatgagagaagtagtaattgccagtgcagctagaacagcagtaggaagttttggaggagcatttaaatcagtttcagcggtagagttaggggtaacagcagctaaagaagctataaaaagagctaacataactccagatatgatagatgaatctcttttagggggagtacttacagcaggtcttggacaaaatatagcaagacaaatagcattaggagcaggaataccagtagaaaaaccagctatgactataaatatagtttgtggttctggattaagatctgtttcaatggcatctcaacttatagcattaggtgatgctgatataatgttagttggtggagctgaaaacatgagtatgtctccttatttagtaccaagtgcgagatatggtgcaagaatgggtgatgctgcttttgttgattcaatgataaaagatggattatcagacatatttaataactatcacatgggtattactgctgaaaacatagcagagcaatggaatataactagagaagaacaagatgaattagctcttgcaagtcaaaataaagctgaaaaagctcaagctgaaggaaaatttgatgaagaaatagttcctgttgttataaaaggaagaaaaggtgacactgtagtagataaagatgaatatattaagcctggcactacaatggagaaacttgctaagttaagacctgcatttaaaaaagatggaacagttactgctggtaatgcatcaggaataaatgatggtgctgctatgttagtagtaatggctaaagaaaaagctgaagaactaggaatagagcctcttgcaactatagtttcttatggaacagctggtgttgaccctaaaataatgggatatggaccagttccagcaactaaaaaagctttagaagctgctaatatgactattgaagatatagatttagttgaagctaatgaggcatttgctgcccaatctgtagctgtaataagagacttaaatatagatatgaataaagttaatgttaatggtggagcaatagctataggacatccaataggatgctcaggagcaagaatacttactacacttttatatgaaatgaagagaagagatgctaaaactggtcttgctacactttgtataggcggtggaatgggaactactttaatagttaagagatagtaagaaggagatatacatatgaaattagctgtaataggtagtggaactatgggaagtggtattgtacaaacttttgcaagttgtggacatgatgtatgtttaaagagtagaactcaaggtgctatagataaatgtttagctttattagataaaaatttaactaagttagttactaagggaaaaatggatgaagctacaaaagcagaaatattaagtcatgttagttcaactactaattatgaagatttaaaagatatggatttaataatagaagcatctgtagaagacatgaatataaagaaagatgttttcaagttactagatgaattatgtaaagaagatactatcttggcaacaaatacttcatcattatctataacagaaatagcttcttctactaagcgcccagataaagttataggaatgcatttctttaatccagttcctatgatgaaattagttgaagttataagtggtcagttaacatcaaaagttacttttgatacagtatttgaattatctaagagtatcaataaagtaccagtagatgtatctgaatctcctggatttgtagtaaatagaatacttatacctatgataaatgaagctgttggtatatatgcagatggtgttgcaagtaaagaagaaatagatgaagctatgaaattaggagcaaaccatccaatgggaccactagcattaggtgatttaatcggattagatgttgttttagctataatgaacgttttatatactgaatttggagatactaaatatagacctcatccacttttagctaaaatggttagagctaatcaattaggaagaaaaactaagataggattctatgattataataaataataagaaggagatatacatatgagtacaagtgatgttaaagtttatgagaatgtagctgttgaagtagatggaaatatatgtacagtgaaaatgaatagacctaaagcccttaatgcaataaattcaaagactttagaagaactttatgaagtatttgtagatattaataatgatgaaactattgatgttgtaatattgacaggggaaggaaaggcatttgtagctggagcagatattgcatacatgaaagatttagatgctgtagctgctaaagattttagtatcttaggagcaaaagcttttggagaaatagaaaatagtaaaaaagtagtgatagctgctgtaaacggatttgctttaggtggaggatgtgaacttgcaatggcatgtgatataagaattgcatctgctaaagctaaatttggtcagccagaagtaactcttggaataactccaggatatggaggaactcaaaggcttacaagattggttggaatggcaaaagcaaaagaattaatctttacaggtcaagttataaaagctgatgaagctgaaaaaatagggctagtaaatagagtcgttgagccagacattttaatagaagaagttgagaaattagctaagataatagctaaaaatgctcagcttgcagttagatactctaaagaagcaatacaacttggtgctcaaactgatataaatactggaatagatatagaatctaatttatttggtctttgtttttcaactaaagaccaaaaagaaggaatgtcagctttcgttgaaaagagagaagctaactttataaaagggtaataagaaggagatatacatatgagaagttttgaagaagtaattaagtttgcaaaagaaagaggacctaaaactatatcagtagcatgttgccaagataaagaagttttaatggcagttgaaatggctagaaaagaaaaaatagcaaatgccattttagtaggagatatagaaaagactaaagaaattgcaaaaagcatagacatggatatcgaaaattatgaactgatagatataaaagatttagcagaagcatctctaaaatctgttgaattagtttcacaaggaaaagccgacatggtaatgaaaggcttagtagacacatcaataatactaaaagcagttttaaataaagaagtaggtcttagaactggaaatgtattaagtcacgtagcagtatttgatgtagagggatatgatagattatttttcgtaactgacgcagctatgaacttagctcctgatacaaatactaaaaagcaaatcatagaaaatgcttgcacagtagcacattcattagatataagtgaaccaaaagttgctgcaatatgcgcaaaagaaaaagtaaatccaaaaatgaaagatacagttgaagctaaagaactagaagaaatgtatgaaagaggagaaatcaaaggttgtatggttggtgggccttttgcaattgataatgcagtatctttagaagcagctaaacataaaggtataaatcatcctgtagcaggacgagctgatatattattagccccagatattgaaggtggtaacatattatataaagctttggtattcttctcaaaatcaaaaaatgcaggagttatagttggggctaaagcaccaataatattaacttctagagcagacagtgaagaaactaaactaaactcaatagctttaggtgttttaatggcagcaaaggcataataagaaggagatatacatatgagcaaaatatttaaaatcttaacaataaatcctggttcgacatcaactaaaatagctgtatttgataatgaggatttagtatttgaaaaaactttaagacattcttcagaagaaataggaaaatatgagaaggtgtctgaccaatttgaatttcgtaaacaagtaatagaagaagctctaaaagaaggtggagtaaaaacatctgaattagatgctgtagtaggtagaggaggacttcttaaacctataaaaggtggtacttattcagtaagtgctgctatgattgaagatttaaaagtgggagttttaggagaacacgcttcaaacctaggtggaataatagcaaaacaaataggtgaagaagtaaatgttccttcatacatagtagaccctgttgttgtagatgaattagaagatgttgctagaatttctggtatgcctgaaataagtagagcaagtgtagtacatgctttaaatcaaaaggcaatagcaagaagatatgctagagaaataaacaagaaatatgaagatataaatcttatagttgcacacatgggtggaggagtttctgttggagctcataaaaatggtaaaatagtagatgttgcaaacgcattagatggagaaggacctttctctccagaaagaagtggtggactaccagtaggtgcattagtaaaaatgtgctttagtggaaaatatactcaagatgaaattaaaaagaaaataaaaggtaatggcggactagttgcatacttaaacactaatgatgctagagaagttgaagaaagaattgaagctggtgatgaaaaagctaaattagtatatgaagctatggcatatcaaatctctaaagaaataggagctagtgctgcagttcttaagggagatgtaaaagcaatattattaactggtggaatcgcatattcaaaaatgtttacagaaatgattgcagatagagttaaatttatagcagatgtaaaagtttatccaggtgaagatgaaatgattgcattagctcaaggtggacttagagttttaactggtgaagaagaggctcaagtttatgataactaa

SEQ ID NO: 215 - DNA, 213 bp, Artificial Sequence
  source: /note="Description of Artificial Sequence: Synthetic polynucleotide"
ggtaccagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatccaaagtgaactctagaaataattttgtttaactttaagaaggagatatacat

SEQ ID NO: 216 - DNA, 43 bp, Artificial Sequence
  source: /note="Description of Artificial Sequence: Synthetic oligonucleotide"
ctctagaaataattttgtttaactttaagaaggagatatacat

SEQ ID NO: 217 - DNA, 6939 bp, Artificial Sequence
  source: /note="Description of Artificial Sequence: Synthetic polynucleotide"
caaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtggccagtgccaagcttgcatgcagattgcagcattacacgtcttgagcgattgtgtaggctggagctgcttcgaagttcctatactttctagagaataggaacttcggaataggaacttcatttaaatggcgcgccttacgccccgccctgccactcatcgcagtactgttgtattcattaagcatctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgtaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacaactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtaggcgcgccgaagttcctatactttctagagaataggaacttcggaataggaactaaggaggatattcatatggaccatggctaattcccaggtaccagttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatccaaagtgaactctagaaataattttgtttaactttaagaaggagatatacatatgtctaacgtgcaggagtggcaacagcttgccaacaaggaattgagccgtcgggagaaaactgtcgactcgctggttcatcaaaccgcggaagggatcgccatcaagccgctgtataccgaagccgatctcgataatctggaggtgacaggtacccttcctggtttgccgccctacgttcgtggcccgcgtgccactatgtataccgcccaaccgtggaccatccgtcagtatgctggtttttcaacagcaaaagagtccaacgctttttatcgccgtaacctggccgccgggcaaaaaggtctttccgttgcgtttgaccttgccacccaccgtggctacgactccgataacccgcgcgtggcgggcgacgtcggcaaagcgggcgtcgctatcgacaccgtggaagatatgaaagtcctgttcgaccagatcccgctggataaaatgtcggtttcgatgaccatgaatggcgcagtgctaccagtactggcgttttatatcgtcgccgcagaagagcaaggtgttacacctgataaactgaccggcaccattcaaaacgatattctcaaagagtacctctgccgcaacacctatatttacccaccaaaaccgtcaatgcgcattatcgccgacatcatcgcctggtgttccggcaacatgccgcgatttaataccatcagtatcagcggttaccacatgggtgaagcgggtgccaactgcgtgcagcaggtagcatttacgctcgctgatgggattgagtacatcaaagcagcaatctctgccggactgaaaattgatgacttcgctcctcgcctgtcgttcttcttcggcatcggcatggatctgtttatgaacgtcgccatgttgcgtgcggcacgttatttatggagcgaagcggtcagtggatttggcgcacaggacccgaaatcactggcgctgcgtacccactgccagacctcaggctggagcctgactgaacaggatccgtataacaacgttatccgcaccaccattgaagcgctggctgcgacgctgggcggtactcagtcactgcataccaacgcctttgacgaagcgcttggtttgcctaccgatttctcagcacgcattgcccgcaacacccagatcatcatccaggaagaatcagaactctgccgcaccgtcgatccactggccggatcctattacattgagtcgctgaccgatcaaatcgtcaaacaagccagagctattatccaacagatcgacgaagccggtggcatggcgaaagcgatcgaagcaggtctgccaaaacgaatgatcgaagaggcctcagcgcgcgaacagtcgctgatcgaccagggcaagcgtgtcatcgttggtgtcaacaagtacaaactggatcacgaagacgaaaccgatgtacttgagatcgacaacgtgatggtgcgtaacgagcaaattgcttcgctggaacgcattcgcgccacccgtgatgatgccgccgtaaccgccgcgttgaacgccctgactcacgccgcacagcataacgaaaacctgctggctgccgctgttaatgccgctcgcgttcgcgccaccctgggtgaaatttccgatgcgctggaagtcgctttcgaccgttatctggtgccaagccagtgtgttaccggcgtgattgcgcaaagctatcatcagtctgagaaatcggcctccgagttcgatgccattgttgcgcaaacggagcagttccttgccgacaatggtcgtcgcccgcgcattctgatcgctaagatgggccaggatggacacgatcgcggcgcgaaagtgatcgccagcgcctattccgatctcggtttcgacgtagatttaagcccgatgttctctacacctgaagagatcgcccgcctggccgtagaaaacgacgttcacgtagtgggcgcatcctcactggctgccggtcataaaacgctgatcccggaactggtcgaagcgctgaaaaaatggggacgcgaagatatctgcgtggtcgcgggtggcgtcattccgccgcaggattacgccttcctgcaagagcgcggcgtggcggcgatttatggtccaggtacacctatgctcgacagtgtgcgcgacgtactgaatctgataagccagcatcatgattaatgaagccacgctggcagaaagtattcgccgcttacgtcagggtgagcgtgccacactcgcccaggccatgacgctggtggaaagccgtcacccgcgtcatcaggcactaagtacgcagctgcttgatgccattatgccgtactgcggtaacaccctgcgactgggcgttaccggcacccccggcgcggggaaaagtacctttcttgaggcctttggcatgttgttgattcgagagggattaaaggtcgcggttattgcggtcgatcccagcagcccggtcactggcggtagcattctcggggataaaacccgcatgaatgacctggcgcgtgccgaagcggcgtttattcgcccggtaccatcctccggtcatctgggcggtgccagtcagcgagcgcgggaattaatgctgttatgcgaagcagcgggttatgacgtagtgattgtcgaaacggttggcgtcgggcagtcggaaacagaagtcgcccgcatggtggactgttttatctcgttgcaaattgccggtggcggcgatgatctgcagggcattaaaaaagggctgatggaagtggctgatctgatcgttatcaacaaagacgatggcgataaccataccaatgtcgccattgcccggcatatgtacgagagtgccctgcatattctgcgacgtaaatacgacgaatggcagccacgggttctgacttgtagcgcactggaaaaacgtggaatcgatgagatctggcacgccatcatcgacttcaaaaccgcgctaactgccagtggtcgtttacaacaagtgcggcaacaacaatcggtggaatggctgcgtaagcagaccgaagaagaagtactgaatcacctgttcgcgaatgaagatttcgatcgctattaccgccagacgcttttagcggtcaaaaacaatacgctctcaccgcgcaccggcctgcggcagctcagtgaatttatccagacgcaatattttgattaaaggaatttttatgtcttatcagtatgttaacgttgtcactatcaacaaagtggcggtcattgagtttaactatggccgaaaacttaatgccttaagtaaagtctttattgatgatcttatgcaggcgttaagcgatctcaaccggccggaaattcgctgtatcattttgcgcgcaccgagtggatccaaagtcttctccgcaggtcacgatattcacgaactgccgtctggcggtcgcgatccgctctcctatgatgatccattgcgtcaaatcacccgcatgatccaaaaattcccgaaaccgatcatttcgatggtggaaggtagtgtttggggtggcgcatttgaaatgatcatgagttccgatctgatcatcgccgccagtacctcaaccttctcaatgacgcctgtaaacctcggcgtcccgtataacctggtcggcattcacaacctgacccgcgacgcgggcttccacattgtcaaagagctgatttttaccgcttcgccaatcaccgcccagcgcgcgctggctgtcggcatcctcaaccatgttgtggaagtggaagaactggaagatttcaccttacaaatggcgcaccacatctctgagaaagcgccgttagccattgccgttatcaaagaagagctgcgtgtactgggcgaagcacacaccatgaactccgatgaatttgaacgtattcaggggatgcgccgcgcggtgtatgacagcgaagattaccaggaagggatgaacgctttcctcgaaaaacgtaaacctaatttcgttggtcattaatccctgcgaacgaaggagtaaaaatggaaactcagtggacaaggatgaccgccaatgaagcggcagaaattatccagcataacgacatggtggcatttagcggctttaccccggcgggttcgccgaaagccctacccaccgcgattgcccgcagagctaacgaacagcatgaggccaaaaagccgtatcaaattcgccttctgacgggtgcgtcaatcagcgccgccgctgacgatgtactttctgacgccgatgctgtttcctggcgtgcgccatatcaaacatcgtccggtttacgtaaaaagatcaatcagggcgcggtgagtttcgttgacctgcatttgagcgaagtggcgcaaatggtcaattacggtttcttcggcgacattgatgttgccgtcattgaagcatcggcactggcaccggatggtcgagtctggttaaccagcgggatcggtaatgcgccgacctggctgctgcgggcgaagaaagtgatcattgaactcaatcactatcacgatccgcgcgttgcagaactggcggatattgtgattcctggcgcgccaccgcggcgcaatagcgtgtcgatcttccatgcaatggatcgcgtcggtacccgctatgtgcaaatcgatccgaaaaagattgtcgccgtcgtggaaaccaacttgcccgacgccggtaatatgctggataagcaaaatcccatgtgccagcagattgccgataacgtggtcacgttcttattgcaggaaatggcgcatgggcgtattccgccggaatttctgccgctgcaaagtggcgtgggcaatatcaataatgcggtaatggcgcgtctgggggaaaacccggtaattcctccgtttatgatgtattcggaagtgctacaggaatcggtggtgcatttactggaaaccggcaaaatcagcggggccagcgcctccagcctgacaatctcggccgattccctgcgcaagatttacgacaatatggattactttgccagccgcattgtgttgcgtccgcaggagatttccaataacccggaaatcatccgtcgtctgggcgtcatcgctctgaacgtcggcctggagtttgatatttacgggcatgccaactcaacacacgtagccggggtcgatctgatgaacggcatcggcggcagcggtgattttgaacgcaacgcgtatctgtcgatctttatggccccgtcgattgctaaagaaggcaagatctcaaccgtcgtgccaatgtgcagccatgttgatcacagcgaacacagcgtcaaagtgatcatcaccgaacaagggatcgccgatctgcgcggtctttccccgcttcaacgcgcccgcactatcattgataattgtgcacatcctatgtatcgggattatctgcatcgctatctggaaaatgcgcctggcggacatattcaccacgatcttagccacgtcttcgacttacaccgtaatttaattgcaaccggctcgatgctgggttaa

SEQ ID NO: 218 - DNA, 5638 bp, Artificial Sequence
  source: /note="Description of Artificial Sequence: Synthetic polynucleotide"
agttgttcttattggtggtgttgctttatggttgcatcgtagtaaatggttgtaacaaaagcaatttttccggctgtctgtatacaaaaacgccgcaaagtttgagcgaagtcaataaactctctacccattcagggcaatatctctcttggatccaaagtgaactctagaaataattttgtttaactttaagaaggagatatacatatgtctaacgtgcaggagtggcaacagcttgccaacaaggaattgagccgtcgggagaaaactgtcgactcgctggttcatcaaaccgcggaagggatcgccatcaagccgctgtataccgaagccgatctcgataatctggaggtgacaggtacccttcctggtttgccgccctacgttcgtggcccgcgtgccactatgtataccgcccaaccgtggaccatccgtcagtatgctggtttttcaacagcaaaagagtccaacgctttttatcgccgtaacctggccgccgggcaaaaaggtctttccgttgcgtttgaccttgccacccaccgtggctacgactccgataacccgcgcgtggcgggcgacgtcggcaaagcgggcgtcgctatcgacaccgtggaagatatgaaagtcctgttcgaccagatcccgctggataaaatgtcggtttcgatgaccatgaatggcgcagtgctaccagtactggcgttttatatcgtcgccgcagaagagcaaggtgttacacctgataaactgaccggcaccattcaaaacgatattctcaaagagtacctctgccgcaacacctatatttacccaccaaaaccgtcaatgcgcattatcgccgacatcatcgcctggtgttccggcaacatgccgcgatttaataccatcagtatcagcggttaccacatgggtgaagcgggtgccaactgcgtgcagcaggtagcatttacgctcgctgatgggattgagtacatcaaagcagcaatctctgccggactgaaaattgatgacttcgctcctcgcctgtcgttcttcttcggcatcggcatggatctgtttatgaacgtcgccatgttgcgtgcggcacgttatttatggagcgaagcggtcagtggatttggcgcacaggacccgaaatcactggcgctgcgtacccactgccagacctcaggctggagcctgactgaacaggatccgtataacaacgttatccgcaccaccattgaagcgctggctgcgacgctgggcggtactcagtcactgcataccaacgcctttgacgaagcgcttggtttgcctaccgatttctcagcacgcattgcccgcaacacccagatcatcatccaggaagaatcagaactctgccgcaccgtcgatccactggccggatcctattacattgagtcgctgaccgatcaaatcgtcaaacaagccagagctattatccaacagatcgacgaagccggtggcatggcgaaagcgatcgaagcaggtctgccaaaacgaatgatcgaagaggcctcagcgcgcgaacagtcgctgatcgaccagggcaagcgtgtcatcgttggtgtcaacaagtacaaactggatcacgaagacgaaaccgatgtacttgagatcgacaacgtgatggtgcgtaacgagcaaattgcttcgctggaacgcattcgcgccacccgtgatgatgccgccgtaaccgccgcgttgaacgccctgactcacgccgcacagcataacgaaaacctgctggctgccgctgttaatgccgctcgcgttcgcgccaccctgggtgaaatttccgatgcgctggaagtcgctttcgaccgttatctggtgccaagccagtgtgttaccggcgtgattgcgcaaagctatcatcagtctgagaaatcggcctccgagttcgatgccattgttgcgcaaacggagcagttccttgccgacaatggtcgtcgcccgcgcattctgatcgctaagatgggccaggatggacacgatcgcggcgcgaaagtgatcgccagcgcctattccgatctcggtttcgacgtagatttaagcccgatgttctctacacctgaagagatcgcccgcctggccgtagaaaacgacgttcacgtagtgggcgcatcctcactggctgccggtcataaaacgctgatcccggaactggtcgaagcgctgaaaaaatggggacgcgaagatatctgcgtggtcgcgggtggcgtcattccgccgcaggattacgccttcctgcaagagcgcggcgtggcggcgatttatggtccaggtacacctatgctcgacagtgtgcgcgacgtactgaatctgataagccagcatcatgattaatgaagccacgctggcagaaagtattcgccgcttacgtcagggtgagcgtgccacactcgcccaggccatgacgctggtggaaagccgtcacccgcgtcatcaggcactaagtacgcagctgcttgatgccattatgccgtactgcggtaacaccctgcgactgggcgttaccggcacccccggcgcggggaaaagtacctttcttgaggcctttggcatgttgttgattcgagagggattaaaggtcgcggttattgcggtcgatcccagcagcccggtcactggcggtagcattctcggggataaaacccgcatgaatgacctggcgcgtgccgaagcggcgtttattcgcccggtaccatcctccggtcatctgggcggtgccagtcagcgagcgcgggaattaatgctgttatgcgaagcagcgggttatgacgtagtgattgtcgaaacggttggcgtcgggcagtcggaaacagaagtcgcccgcatggtggactgttttatctcgttgcaaattgccggtggcggcgatgatctgcagggcattaaaaaagggctgatggaagtggctgatctgatcgttatcaacaaagacgatggcgataaccataccaatgtcgccattgcccggcatatgtacgagagtgccctgcatattctgcgacgtaaatacgacgaatggcagccacgggttctgacttgtagcgcactggaaaaacgtggaatcgatgagatctggcacgccatcatcgacttcaaaaccgcgctaactgccagtggtcgtttacaacaagtgcggcaacaacaatcggtggaatggctgcgtaagcagaccgaagaagaagtactgaatcacctgttcgcgaatgaagatttcgatcgctattaccgccagacgcttttagcggtcaaaaacaatacgctctcaccgcgcaccggcctgcggcagctcagtgaatttatccagacgcaatattttgattaaaggaatttttatgtcttatcagtatgttaacgttgtcactatcaacaaagtggcggtcattgagtttaactatggccgaaaacttaatgccttaagtaaagtctttattgatgatcttatgcaggcgttaagcgatctcaaccggccggaaattcgctgtatcattttgcgcgcaccgagtggatccaaagtcttctccgcaggtcacgatattcacgaactgccgtctggcggtcgcgatccgctctcctatgatgatccattgcgtcaaatcacccgcatgatccaaaaattcccgaaaccgatcatttcgatggtggaaggtagtgtttggggtggcgcatttgaaatgatcatgagttccgatctgatcatcgccgccagtacctcaaccttctcaatgacgcctgtaaacctcggcgtcccgtataacctggtcggcattcacaacctgacccgcgacgcgggcttccacattgtcaaagagctgatttttaccgcttcgccaatcaccgcccagcgcgcgctggctgtcggcatcctcaaccatgttgtggaagtggaagaactggaagatttcaccttacaaatggcgcaccacatctctgagaaagcgccgttagccattgccgttatcaaagaagagctgcgtgtactgggcgaagcacacaccatgaactccgatgaatttgaacgtattcaggggatgcgccgcgcggtgtatgacagcgaagattaccaggaagggatgaacgctttcctcgaaaaacgtaaacctaatttcgttggtcattaatccctgcgaacgaaggagtaaaaatggaaactcagtggacaaggatgaccgccaatgaagcggcagaaattatccagcataacgacatggtggcatttagcggctttaccccggcgggttcgccgaaagccctacccaccgcgattgcccgcagagctaacgaacagcatgaggccaaaaagccgtatcaaattcgccttctgacgggtgcgtcaatcagcgccgccgctgacgatgtactttctgacgccgatgctgtttcctggcgtgcgccatatcaaacatcgtccggtttacgtaaaaagatcaatcagggcgcggtgagtttcgttgacctgcatttgagcgaagtggcgcaaatggtcaattacggtttcttcggcgacattgatgttgccgtcattgaagcatcggcactggcaccggatggtcgagtctggttaaccagcgggatcggtaatgcgccgacctggctgctgcgggcgaagaaagtgatcattgaactcaatcactatcacgatccgcgcgttgcagaactggcggatattgtgattcctggcgcgccaccgcggcgcaatagcgtgtcgatcttccatgcaatggatcgcgtcggtacccgctatgtgcaaatcgatccgaaaaagattgtcgccgtcgtggaaaccaacttgcccgacgccggtaatatgctggataagcaaaatcccatgtgccagcagattgccgataacgtggtcacgttcttattgcaggaaatggcgcatgggcgtattccgccggaatttctgccgctgcaaagtggcgtgggcaatatcaataatgcggtaatggcgcgtctgggggaaaacccggtaattcctccgtttatgatgtattcggaagtgctacaggaatcggtggtgcatttactggaaaccggcaaaatcagcggggccagcgcctccagcctgacaatctcggccgattccctgcgcaagatttacgacaatatggattactttgccagccgcattgtgttgcgtccgcaggagatttccaataacccggaaatcatccgtcgtctgggcgtcatcgctctgaacgtcggcctggagtttgatatttacgggcatgccaactcaacacacgtagccggggtcgatctgatgaacggcatcggcggcagcggtgattttgaacgcaacgcgtatctgtcgatctttatggccccgtcgattgctaaagaaggcaagatctcaaccgtcgtgccaatgtgcagccatgttgatcacagcgaacacagcgtcaaagtgatcatcaccgaacaagggatcgccgatctgcgcggtctttccccgcttcaacgcgcccgcactatcattgataattgtgcacatcctatgtatcgggattatctgcatcgctatctggaaaatgcgcctggcggacatattcaccacgatcttagccacgtcttcgacttacaccgtaatttaattgcaaccggctcgatgctgggttaa

SEQ ID NO: 219 - DNA, 8698 bp, Artificial Sequence
  source: /note="Description of Artificial Sequence: Synthetic polynucleotide"
ttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatgcgcaaagtgccgattatcacggctgacgaggccgcaaaactgatcaaggacggcgacaccgtgacaactagcggctttgtgggtaacgcgatccctgaggcccttgaccgtgcagtcgaaaagcgtttcctggaaacgggcgaaccgaagaacattacttatgtatattgcggcagtcagggcaatcgcgacggtcgtggcgcagaacatttcgcgcatgaaggcctgctgaaacgttatatcgctggccattgggcgaccgtcccggcgttagggaaaatggccatggagaataaaatggaggcctacaatgtctctcagggcgccttgtgtcatctctttcgcgatattgcgagccataaaccgggtgtgttcacgaaagtaggaatcggcaccttcattgatccacgtaacggtggtgggaaggtcaacgatattaccaaggaagatatcgtagaactggtggaaattaaagggcaggaatacctgttttatccggcgttcccgatccatgtcgcgctgattcgtggcacctatgcggacgagagtggtaacatcacctttgaaaaagaggtagcgcctttggaagggacttctgtctgtcaagcggtgaagaactcgggtggcattgtcgtggttcaggttgagcgtgtcgtcaaagcaggcacgctggatccgcgccatgtgaaagttccgggtatctatgtagattacgtagtcgtcgcggatccggaggaccatcaacagtcccttgactgcgaatatgatcctgcccttagtggagagcaccgtcgtccggaggtggtgggtgaaccactgcctttatccgcgaagaaagtcatcggccgccgtggcgcgattgagctcgagaaagacgttgcagtgaaccttggggtaggtgcacctgagtatgtggcctccgtggccgatgaagaaggcattgtggattttatgactctcacagcggagtccggcgctatcggtggcgttccagccggcggtgttcgctttggggcgagctacaatgctgacgccttgatcgaccagggctaccaatttgattattacgacggtgggggtctggatctttgttacctgggtttagctgaatgcgacgaaaagggtaatatcaatgttagccgcttcggtcctcgtatcgctgggtgcggcggattcattaacattacccaaaacacgccgaaagtcttcttttgtgggacctttacagccggggggctgaaagtgaaaattgaagatggtaaggtgattatcgttcaggaagggaaacagaagaaattccttaaggcagtggagcaaatcacctttaatggagacgtggccttagcgaacaagcaacaagttacctacatcacggagcgttgcgtcttcctcctcaaagaagacggtttacacctttcggaaatcgcgccaggcatcgatctgcagacccagattttggatgttatggactttgccccgatcattgatcgtgacgcaaacgggcagattaaactgatggacgcggcgttattcgcagaagggctgatgggcttgaaagaaatgaagtcttgataagaaggagatatacatatgagcttaacccaaggcatgaaagctaaacaactgttagcatactttcagggtaaagccgatcaggatgcacgtgaagcgaaagcccgcggtgagctggtctgctggtcggcgtcagtcgcgccgccggaattttgcgtaacaatgggcattgccatgatctacccggagactcatgcagcgggcatcggtgcccgcaaaggtgcgatggacatgctggaagttgcggaccgcaaaggctacaacgtggattgttgttcctacggccgtgtaaatatgggttacatggaatgtttaaaagaagccgccatcacgggcgtcaagccggaagttttggttaattcccctgctgctgacgttccgcttcccgatttggtgattacgtgtaataatatctgtaacacgctgctgaaatggtacgaaaacttagcagcagaactcgatattccttgcatcgtgatcgacgtaccgtttaatcataccatgccgattccggaatatgccaaggcctacatcgcggaccagttccgcaatgcaatttctcagctggaagttatttgtggccgtccgttcgattggaagaaatttaaggaggtcaaagatcagacccagcgtagcgtataccactggaaccgcattgccgagatggcgaaatacaagcctagcccgctgaacggcttcgatctgttcaattacatggcgttaatcgtggcgtgccgcagcctggattatgcagaaattacctttaaagcgttcgcggacgaattagaagagaatttgaaggcgggtatctacgcctttaaaggtgcggaaaaaacgcgctttcaatgggaaggtatcgcggtgtggccacatttaggtcacacgtttaaatctatgaagaatctgaattcgattatgaccggtacggcataccccgccctttgggacctgcactatgacgctaacgacgaatctatgcactctatggctgaagcgtacacccgtatttatattaatacttgtctgcagaacaaagtagaggtcctgcttgggatcatggaaaaaggccaggtggatggtaccgtatatcatctgaatcgcagctgcaaactgatgagtttcctgaacgtggaaacggctgaaattattaaagagaagaacggtcttccttacgtctccattgatggcgatcagaccgatcctcgcgttttttctccggcccagtttgatacccgtgttcaggccctggttgagatgatggaggccaatatggcggcagcggaataataagaaggagatatacatatgtcacgcgtggaggcaatcctgtcgcagctgaaagatgtcgccgcgaatccgaaaaaagccatggatgactataaagctgaaacaggtaagggcgcggttggtatcatgccgatctacagccccgaagaaatggtacacgccgctggctatttgccgatgggaatctggggcgcccagggcaaaacgattagtaaagcgcgcacctatctgcctgcttttgcctgcagcgtaatgcagcaggttatggaattacagtgcgagggcgcgtatgatgacctgtccgcagttatttttagcgtaccgtgcgacactctcaaatgtcttagccagaaatggaaaggtacgtccccagtgattgtatttacgcatccgcagaaccgcggattagaagcggcgaaccaattcttggttaccgagtatgaactggtaaaagcacaactggaatcagttctgggtgtgaaaatttcaaacgccgccctggaaaattcgattgcaatttataacgagaatcgtgccgtgatgcgtgagttcgtgaaagtggcagcggactatcctcaagtcattgacgcagtgagccgccacgcggtttttaaagcgcgccagtttatgcttaaggaaaaacataccgcacttgtgaaagaactgatcgctgagattaaagcaacgccagtccagccgtgggacggaaaaaaggttgtagtgacgggcattctgttggaaccgaatgagttattagatatctttaatgagtttaagatcgcgattgttgatgatgatttagcgcaggaaagccgtcagatccgtgttgacgttctggacggagaaggcggaccgctctaccgtatggctaaagcgtggcagcaaatgtatggctgctcgctggcaaccgacaccaagaagggtcgcggccgtatgttaattaacaaaacgattcagaccggtgcggacgctatcgtagttgcaatgatgaagttttgcgacccagaagaatgggattatccggtaatgtaccgtgaatttgaagaaaaaggggtcaaatcacttatgattgaggtggatcaggaagtatcgtctttcgaacagattaaaacccgtctgcagtcattcgtcgaaatgctttaataagaaggagatatacatatgtataccttggggattgatgtcggttctgcctctagtaaagcggtgattctgaaagatggaaaagatattgtcgctgccgaggttgtccaagtcggtaccggctcctcgggtccccaacgcgcactggacaaagcctttgaagtctctggcttaaaaaaggaagacatcagctacacagtagctacgggctatgggcgcttcaattttagcgacgcggataaacagatttcggaaattagctgtcatgccaaaggcatttatttcttagtaccaactgcgcgcactattattgacattggcggccaagatgcgaaagccatccgcctggacgacaaggggggtattaagcaattcttcatgaatgataaatgcgcggcgggcacggggcgtttcctggaagtcatggctcgcgtacttgaaaccaccctggatgaaatggctgaactggatgaacaggcgactgacaccgctcccatttcaagcacctgcacggttttcgccgaaagcgaagtaattagccaattgagcaatggtgtctcacgcaacaacatcattaaaggtgtccatctgagcgttgcgtcacgtgcgtgtggtctggcgtatcgcggcggtttggagaaagatgttgttatgacaggtggcgtggcaaaaaatgcaggggtggtgcgcgcggtggcgggcgttctgaagaccgatgttatcgttgctccgaatcctcagacgaccggtgcactgggggcagcgctgtatgcttatgaggccgcccagaagaagtaataagaaggagatatacatatggccttcaatagcgcagatattaattctttccgcgatatttgggtgttttgtgaacagcgtgagggcaaactgattaacaccgatttcgaattaattagcgaaggtcgtaaactggctgacgaacgcggaagcaaactggttggaattttgctggggcacgaagttgaagaaatcgcaaaagaattaggcggctatggtgcggacaaggtaattgtgtgcgatcatccggaacttaaattttacactacggatgcttatgccaaagttttatgtgacgtcgtgatggaagagaaaccggaggtaattttgatcggtgccaccaacattggccgtgatctcggaccgcgttgtgctgcacgcttgcacacggggctgacggctgattgcacgcacctggatattgatatgaataaatatgtggactttcttagcaccagtagcaccttggatatctcgtcgatgactttccctatggaagatacaaaccttaaaatgacgcgccctgcatttggcggacatctgatggcaacgatcatttgtccacgcttccgtccctgtatgagcacagtgcgccccggagtgatgaagaaagcggagttctcgcaggagatggcgcaagcatgtcaagtagtgacccgtcacgtaaatttgtcggatgaagaccttaaaactaaagtaattaatatcgtgaaggaaacgaaaaagattgtggatctgatcggcgcagaaattattgtgtcagttggtcgtggtatctcgaaagatgtccaaggtggaattgcactggctgaaaaacttgcggacgcatttggtaacggtgtcgtgggcggctcgcgcgcagtgattgattccggctggttacctgcggatcatcaggttggacaaaccggtaagaccgtgcacccgaaagtctacgtggcgctgggtattagtggggctatccagcataaggctgggatgcaagactctgaactgatcattgccgtcaacaaagacgaaacggcgcctatcttcgactgcgccgattatggcatcaccggtgatttatttaaaatcgtaccgatgatgatcgacgcgatcaaagagggtaaaaacgcatgataagaaggagatatacatatgcgcatctatgtgtgtgtgaaacaagtcccagatacgagcggcaaggtggccgttaaccctgatgggacccttaaccgtgcctcaatggcagcgattattaacccggacgatatgtccgcgatcgaacaggcattaaaactgaaagatgaaaccggatgccaggttacggcgcttacgatgggtcctcctcctgccgagggcatgttgcgcgaaattattgcaatgggggccgacgatggtgtgctgatttcggcccgtgaatttggggggtccgataccttcgcaaccagtcaaattattagcgcggcaatccataaattaggcttaagcaatgaagacatgatcttttgcggtcgtcaggccattgacggtgatacggcccaagtcggccctcaaattgccgaaaaactgagcatcccacaggtaacctatggcgcaggaatcaaaaaatctggtgatttagtgctggtgaagcgtatgttggaggatggttatatgatgatcgaagtcgaaactccatgtctgattacctgcattcaggataaagcggtaaaaccacgttacatgactctcaacggtattatggaatgctactccaagccgctcctcgttctcgattacgaagcactgaaagatgaaccgctgatcgaacttgataccattgggcttaaaggctccccgacgaatatctttaaatcgtttacgccgcctcagaaaggcgttggtgtcatgctccaaggcaccgataaggaaaaagtcgaggatctggtggataagctgatgcagaaacatgtcatctaataagaaggagatatacatatgttcttactgaagattaaaaaagaacgtatgaaacgcatggactttagtttaacgcgtgaacaggagatgttaaaaaaactggcgcgtcagtttgctgagatcgagctggaaccggtggccgaagagattgatcgtgagcacgtttttcctgcagaaaactttaagaagatggcggaaattggcttaaccggcattggtatcccgaaagaatttggtggctccggtggaggcaccctggagaaggtcattgccgtgtcagaattcggcaaaaagtgtatggcctcagcttccattttaagcattcatcttatcgcgccgcaggcaatctacaaatatgggaccaaagaacagaaagagacgtacctgccgcgtcttaccaaaggtggtgaactgggcgcctttgcgctgacagaaccaaacgccggaagcgatgccggcgcggtaaaaacgaccgcgattctggacagccagacaaacgagtacgtgctgaatggcaccaaatgctttatcagcgggggcgggcgcgcgggtgttcttgtaatttttgcgcttactgaaccgaaaaaaggtctgaaagggatgagcgcgattatcgtggagaaagggaccccgggcttcagcatcggcaaggtggagagcaagatggggatcgcaggttcggaaaccgcggaacttatcttcgaagattgtcgcgttccggctgccaaccttttaggtaaagaaggcaaaggctttaaaattgctatggaagccctggatggcgcccgtattggcgtgggcgctcaagcaatcggaattgccgagggggcgatcgacctgagtgtgaagtacgttcacgagcgcattcaatttggtaaaccgatcgcgaatctgcagggaattcaatggtatatcgcggatatggcgaccaaaaccgccgcggcacgcgcacttgttgagtttgcagcgtatcttgaagacgcgggtaaaccgttcacaaaggaatctgctatgtgcaagctgaacgcctccgaaaacgcgcgttttgtgacaaatttagctctgcagattcacgggggttacggttatatgaaagattatccgttagagcgtatgtatcgcgatgctaagattacggaaatttacgaggggacatcagaaatccataaggtggtgattgcgcgtgaagtaatgaaacgctaa

SEQ ID NO: 220 - DNA, 7950 bp, Artificial Sequence
  source: /note="Description of Artificial Sequence: Synthetic polynucleotide"
atgcgcaaagtgccgattatcacggctgacgaggccgcaaaactgatcaaggacggcgacaccgtgacaactagcggctttgtgggtaacgcgatccctgaggcccttgaccgtgcagtcgaaaagcgtttcctggaaacgggcgaaccgaagaacattacttatgtatattgcggcagtcagggcaatcgcgacggtcgtggcgcagaacatttcgcgcatgaaggcctgctgaaacgttatatcgctggccattgggcgaccgtcccggcgttagggaaaatggccatggagaataaaatggaggcctacaatgtctctcagggcgccttgtgtcatctctttcgcgatattgcgagccataaaccgggtgtgttcacgaaagtaggaatcggcaccttcattgatccacgtaacggtggtgggaaggtcaacgatattaccaaggaagatatcgtagaactggtggaaattaaagggcaggaatacctgttttatccggcgttcccgatccatgtcgcgctgattcgtggcacctatgcggacgagagtggtaacatcacctttgaaaaagaggtagcgcctttggaagggacttctgtctgtcaagcggtgaagaactcgggtggcattgtcgtggttcaggttgagcgtgtcgtcaaagcaggcacgctggatccgcgccatgtgaaagttccgggtatctatgtagattacgtagtcgtcgcggatccggaggaccatcaacagtcccttgactgcgaatatgatcctgcccttagtggagagcaccgtcgtccggaggtggtgggtgaaccactgcctttatccgcgaagaaagtcatcggccgccgtggcgcgattgagctcgagaaagacgttgcagtgaaccttggggtaggtgcacctgagtatgtggcctccgtggccgatgaagaaggcattgtggattttatgactctcacagcggagtccggcgctatcggtggcgttccagccggcggtgttcgctttggggcgagctacaatgctgacgccttgatcgaccagggctaccaatttgattattacgacggtgggggtctggatctttgttacctgggtttagctgaatgcgacgaaaagggtaatatcaatgttagccgcttcggtcctcgtatcgctgggtgcggcggattcattaacattacccaaaacacgccgaaagtcttcttttgtgggacctttacagccggggggctgaaagtgaaaattgaagatggtaaggtgattatcgttcaggaagggaaacagaagaaattccttaaggcagtggagcaaatcacctttaatggagacgtggccttagcgaacaagcaacaagttacctacatcacggagcgttgcgtcttcctcctcaaagaagacggtttacacctttcggaaatcgcgccaggcatcgatctgcagacccagattttggatgttatggactttgccccgatcattgatcgtgacgcaaacgggcagattaaactgatggacgcggcgttattcgcagaagggctgatgggcttgaaagaaatgaagtcttgataagaaggagatatacatatgagcttaacccaaggcatgaaagctaaacaactgttagcatactttcagggtaaagccgatcaggatgcacgtgaagcgaaagcccgcggtgagctggtctgctggtcggcgtcagtcgcgccgccggaattttgcgtaacaatgggcattgccatgatctacccggagactcatgcagcgggcatcggtgcccgcaaaggtgcgatggacatgctggaagttgcggaccgcaaaggctacaacgtggattgttgttcctacggccgtgtaaatatgggttacatggaatgtttaaaagaagccgccatcacgggcgtcaagccggaagttttggttaattcccctgctgctgacgttccgcttcccgatttggtgattacgtgtaataatatctgtaacacgctgctgaaatggtacgaaaacttagcagcagaactcgatattccttgcatcgtgatcgacgtaccgtttaatcataccatgccgattccggaatatgccaaggcctacatcgcggaccagttccgcaatgcaatttctcagctggaagttatttgtggccgtccgttcgattggaagaaatttaaggaggtcaaagatcagacccagcgtagcgtataccactggaaccgcattgccgagatggcgaaatacaagcctagcccgctgaacggcttcgatctgttcaattacatggcgttaatcgtggcgtgccgcagcctggattatgcagaaattacctttaaagcgttcgcggacgaattagaagagaatttgaaggcgggtatctacgcctttaaaggtgcggaaaaaacgcgctttcaatgggaaggtatcgcggtgtggccacatttaggtcacacgtttaaatctatgaagaatctgaattcgattatgaccggtacggcataccccgccctttgggacctgcactatgacgctaacgacgaatctatgcactctatggctgaagcgtacacccgtatttatattaatacttgtctgcagaacaaagtagaggtcctgcttgggatcatggaaaaaggccaggtggatggtaccgtatatcatctgaatcgcagctgcaaactgatgagtttcctgaacgtggaaacggctgaaattattaaagagaagaacggtcttccttacgtctccattgatggcgatcagaccgatcctcgcgttttttctccggcccagtttgatacccgtgttcaggccctggttgagatgatggaggccaatatggcggcagcggaataataagaaggagatatacatatgtcacgcgtggaggcaatcctgtcgcagctgaaagatgtcgccgcgaatccgaaaaaagccatggatgactataaagctgaaacaggtaagggcgcggttggtatcatgccgatctacagccccgaagaaatggtacacgccgctggctatttgccgatgggaatctggggcgcccagggcaaaacgattagtaaagcgcgcacctatctgcctgcttttgcctgcagcgtaatgcagcaggttatggaattacagtgcgagggcgcgtatgatgacctgtccgcagttatttttagcgtaccgtgcgacactctcaaatgtcttagccagaaatggaaaggtacgtccccagtgattgtatttacgcatccgcagaaccgcggattagaagcggcgaaccaattcttggttaccgagtatgaactggtaaaagcacaactggaatcagttctgggtgtgaaaatttcaaacgccgccctggaaaattcgattgcaatttataacgagaatcgtgccgtgatgcgtgagttcgtgaaagtggcagcggactatcctcaagtcattgacgcagtgagccgccacgcggtttttaaagcgcgccagtttatgcttaaggaaaaacataccgcacttgtgaaagaactgatcgctgagattaaagcaacgccagtccagccgtgggacggaaaaaaggttgtagtgacgggcattctgttggaaccgaatgagttattagatatctttaatgagtttaagatcgcgattgttgatgatgatttagcgcaggaaagccgtcagatccgtgttgacgttctggacggagaaggcggaccgctctaccgtatggctaaagcgtggcagcaaatgtatggctgctcgctggcaaccgacaccaagaagggtcgcggccgtatgttaattaacaaaacgattcagaccggtgcggacgctatcgtagttgcaatgatgaagttttgcgacccagaagaatgggattatccggtaatgtaccgtgaatttgaagaaaaaggggtcaaatcacttatgattgaggtggatcaggaagtatcgtctttcgaacagattaaaacccgtctgcagtcattcgtcgaaatgctttaataagaaggagatatacatatgtataccttggggattgatgtcggttctgcctctagtaaagcggtgattctgaaagatggaaaagatattgtcgctgccgaggttgtccaagtcggtaccggctcctcgggtccccaacgcgcactggacaaagcctttgaagtctctggcttaaaaaaggaagacatcagctacacagtagctacgggctatgggcgcttcaattttagcgacgcggataaacagatttcggaaattagctgtcatgccaaaggcatttatttcttagtaccaactgcgcgcactattattgacattggcggccaagatgcgaaagccatccgcctggacgacaaggggggtattaagcaattcttcatgaatgataaatgcgcggcgggcacggggcgtttcctggaagtcatggctcgcgtacttgaaaccaccctggatgaaatggctgaactggatgaacaggcgactgacaccgctcccatttcaagcacctgcacggttttcgccgaaagcgaagtaattagccaattgagcaatggtgtctcacgcaacaacatcattaaaggtgtccatctgagcgttgcgtcacgtgcgtgtggtctggcgtatcgcggcggtttggagaaagatgttgttatgacaggtggcgtggcaaaaaatgcaggggtggtgcgcgcggtggcgggcgttctgaagaccgatgttatcgttgctccgaatcctcagacgaccggtgcactgggggcagcgctgtatgcttatgaggccgcccagaagaagtaataagaaggagatatacatatggccttcaatagcgcagatattaattctttccgcgatatttgggtgttttgtgaacagcgtgagggcaaactgattaacaccgatttcgaattaattagcgaaggtcgtaaactggctgacgaacgcggaagcaaactggttggaattttgctggggcacgaagttgaagaaatcgcaaaagaattaggcggctatggtgcggacaaggtaattgtgtgcgatcatccggaacttaaattttacactacggatgcttatgccaaagttttatgtgacgtcgtgatggaagagaaaccggaggtaattttgatcggtgccaccaacattggccgtgatctcggaccgcgttgtgctgcacgcttgcacacggggctgacggctgattgcacgcacctggatattgatatgaataaatatgtggactttcttagcaccagtagcaccttggatatctcgtcgatgactttccctatggaagatacaaaccttaaaatgacgcgccctgcatttggcggacatctgatggcaacgatcatttgtccacgcttccgtccctgtatgagcacagtgcgccccggagtgatgaagaaagcggagttctcgcaggagatggcgcaagcatgtcaagtagtgacccgtcacgtaaatttgtcggatgaagaccttaaaactaaagtaattaatatcgtgaaggaaacgaaaaagattgtggatctgatcggcgcagaaattattgtgtcagttggtcgtggtatctcgaaagatgtccaaggtggaattgcactggctgaaaaacttgcggacgcatttggtaacggtgtcgtgggcggctcgcgcgcagtgattgattccggctggttacctgcggatcatcaggttggacaaaccggtaagaccgtgcacccgaaagtctacgtggcgctgggtattagtggggctatccagcataaggctgggatgcaagactctgaactgatcattgccgtcaacaaagacgaaacggcgcctatcttcgactgcgccgattatggcatcaccggtgatttatttaaaatcgtaccgatgatgatcgacgcgatcaaagagggtaaaaacgcatgataagaaggagatatacatatgcgcatctatgtgtgtgtgaaacaagtcccagatacgagcggcaaggtggccgttaaccctgatgggacccttaaccgtgcctcaatggcagcgattattaacccggacgatatgtccgcgatcgaacaggcattaaaactgaaagatgaaaccggatgccaggttacggcgcttacgatgggtcctcctcctgccgagggcatgttgcgcgaaattattgcaatgggggccgacgatggtgtgctgatttcggcccgtgaatttggggggtccgataccttcgcaaccagtcaaattattagcgcggcaatccataaattaggcttaagcaatgaagacatgatcttttgcggtcgtcaggccattgacggtgatacggcccaagtcggccctcaaattgccgaaaaactgagcatcccacaggtaacctatggcgcaggaatcaaaaaatctggtgatttagtgctggtgaagcgtatgttggaggatggttatatgatgatcgaagtcgaaactccatgtctgattacctgcattcaggataaagcggtaaaaccacgttacatgactctcaacggtattatggaatgctactccaagccgctcctcgttctcgattacgaagcactgaaagatgaaccgctgatcgaacttgataccattgggcttaaaggctccccgacgaatatctttaaatcgtttacgccgcctcagaaaggcgttggtgtcatgctccaaggcaccgataaggaaaaagtcgaggatctggtggataagctgatgcagaaacatgtcatctaataagaaggagatatacatatgttcttactgaagattaaaaaagaacgtatgaaacgcatggactttagtttaacgcgtgaacaggagatgttaaaaaaactggcgcgtcagtttgctgagatcgagctggaaccggtggccgaagagattgatcgtgagcacgtttttcctgcagaaaactttaagaagatggcggaaattggcttaaccggcattggtatcccgaaagaatttggtggctccggtggaggcaccctggagaaggtcattgccgtgtcagaattcggcaaaaagtgtatggcctcagcttccattttaagcattcatcttatcgcgccgcaggcaatctacaaatatgggaccaaagaacagaaagagacgtacctgccgcgtcttaccaaaggtggtgaactgggcgcctttgcgctgacagaaccaaacgccggaagcgatgccggcgcggtaaaaacgaccgcgattctggacagccagacaaacgagtacgtgctgaatggcaccaaatgctttatcagcgggggcgggcgcgcgggtgttcttgtaatttttgcgcttactgaaccgaaaaaaggtctgaaagggatgagcgcgattatcgtggagaaagggaccccgggcttcagcatcggcaaggtggagagcaagatggggatcgcaggttcggaaaccgcggaacttatcttcgaagattgtcgcgttccggctgccaaccttttaggtaaagaaggcaaaggctttaaaattgctatggaagccctggatggcgcccgtattggcgtgggcgctcaagcaatcggaattgccgagggggcgatcgacctgagtgtgaagtacgttcacgagcgcattcaatttggtaaaccgatcgcgaatctgcagggaattcaatggtatatcgcggatatggcgaccaaaaccgccgcggcacgcgcacttgttgagtttgcagcgtatcttgaagacgcgggtaaaccgttcacaaaggaatctgctatgtgcaagctgaacgcctccgaaaacgcgcgttttgtgacaaatttagctctgcagattcacgggggttacggttatatgaaagattatccgttagagcgtatgtatcgcgatgctaagattacggaaatttacgaggggacatcagaaatccataaggtggtgattgcgcgtgaagtaatgaaacgctaa

SEQ ID NO: 221 - DNA, 7012 bp, Artificial Sequence
  source: /note="Description of Artificial Sequence: Synthetic polynucleotide"
caactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatgtaaaacgacggccagtgaattcgttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaactctagaaataattttgtttaactttaagaaggagatatacatatgcgtgcggtactgatcgagaagtccgatgatacacagtccgtctctgtcaccgaactggctgaagatcaactgccggaaggcgacgttttggtagatgttgcttattcaacactgaactacaaagacgccctggcaattaccggtaaagcccccgtcgttcgtcgttttccgatggtacctggaatcgactttacgggtaccgtggcccagtcttcccacgccgacttcaagccaggtgatcgcgtaatcctgaatggttggggtgtgggggaaaaacattggggcggtttagcggagcgcgctcgcgtgcgcggagactggcttgttcccttgccagcccccctggacttacgccaagcggccatgatcggtacagcaggatacacggcgatgttgtgcgttctggcgcttgaacgtcacggagtggtgccgggtaatggggaaatcgtggtgtccggtgcagcaggcggcgtcggctccgttgcgacgacccttcttgccgctaagggctatgaggtagcggcagtgactggacgtgcgtccgaagcagaatatctgcgcggtttgggggcggcgagcgtaattgatcgtaacgaattaacggggaaggtacgcccgctgggtcaggagcgttgggctggcgggattgacgtggcgggatcaaccgtgcttgcgaacatgctttctatgatgaagtatcgcggggtagtcgctgcgtgtggcctggccgcgggcatggatctgcccgcgtctgtcgcgccctttattcttcgtgggatgacgctggcaggggtggatagcgttatgtgcccaaagacagatcgtttagcagcgtgggcccgtttggcgtcagatcttgaccctgccaagctggaggagatgactacagagttgccgtttagtgaagtaatcgagacagcacccaaattcttggacgggacggttcgtggccgcattgttatccccgtaacgccctaagaactctagaaataattttgtttaactttaagaaggagatatacatatgcgcaaagtgccgattatcacggctgacgaggccgcaaaactgatcaaggacggcgacaccgtgacaactagcggctttgtgggtaacgcgatccctgaggcccttgaccgtgcagtcgaaaagcgtttcctggaaacgggcgaaccgaagaacattacttatgtatattgcggcagtcagggcaatcgcgacggtcgtggcgcagaacatttcgcgcatgaaggcctgctgaaacgttatatcgctggccattgggcgaccgtcccggcgttagggaaaatggccatggagaataaaatggaggcctacaatgtctctcagggcgccttgtgtcatctctttcgcgatattgcgagccataaaccgggtgtgttcacgaaagtaggaatcggcaccttcattgatccacgtaacggtggtgggaaggtcaacgatattaccaaggaagatatcgtagaactggtggaaattaaagggcaggaatacctgttttatccggcgttcccgatccatgtcgcgctgattcgtggcacctatgcggacgagagtggtaacatcacctttgaaaaagaggtagcgcctttggaagggacttctgtctgtcaagcggtgaagaactcgggtggcattgtcgtggttcaggttgagcgtgtcgtcaaagcaggcacgctggatccgcgccatgtgaaagttccgggtatctatgtagattacgtagtcgtcgcggatccggaggaccatcaacagtcccttgactgcgaatatgatcctgcccttagtggagagcaccgtcgtccggaggtggtgggtgaaccactgcctttatccgcgaagaaagtcatcggccgccgtggcgcgattgagctcgagaaagacgttgcagtgaaccttggggtaggtgcacctgagtatgtggcctccgtggccgatgaagaaggcattgtggattttatgactctcacagcggagtccggcgctatcggtggcgttccagccggcggtgttcgctttggggcgagctacaatgctgacgccttgatcgaccagggctaccaatttgattattacgacggtgggggtctggatctttgttacctgggtttagctgaatgcgacgaaaagggtaatatcaatgttagccgcttcggtcctcgtatcgctgggtgcggcggattcattaacattacccaaaacacgccgaaagtcttcttttgtgggacctttacagccggggggctgaaagtgaaaattgaagatggtaaggtgattatcgttcaggaagggaaacagaagaaattccttaaggcagtggagcaaatcacctttaatggagacgtggccttagcgaacaagcaacaagttacctacatcacggagcgttgcgtcttcctcctcaaagaagacggtttacacctttcggaaatcgcgccaggcatcgatctgcagacccagattttggatgttatggactttgccccgatcattgatcgtgacgcaaacgggcagattaaactgatggacgcggcgttattcgcagaagggctgatgggcttgaaagaaatgaagtcttgataagaaggagatatacatatgagcttaacccaaggcatgaaagctaaacaactgttagcatactttcagggtaaagccgatcaggatgcacgtgaagcgaaagcccgcggtgagctggtctgctggtcggcgtcagtcgcgccgccggaattttgcgtaacaatgggcattgccatgatctacccggagactcatgcagcgggcatcggtgcccgcaaaggtgcgatggacatgctggaagttgcggaccgcaaaggctacaacgtggattgttgttcctacggccgtgtaaatatgggttacatggaatgtttaaaagaagccgccatcacgggcgtcaagccggaagttttggttaattcccctgctgctgacgttccgcttcccgatttggtgattacgtgtaataatatctgtaacacgctgctgaaatggtacgaaaacttagcagcagaactcgatattccttgcatcgtgatcgacgtaccgtttaatcataccatgccgattccggaatatgccaaggcctacatcgcggaccagttccgcaatgcaatttctcagctggaagttatttgtggccgtccgttcgattggaagaaatttaaggaggtcaaagatcagacccagcgtagcgtataccactggaaccgcattgccgagatggcgaaatacaagcctagcccgctgaacggcttcgatctgttcaattacatggcgttaatcgtggcgtgccgcagcctggattatgcagaaattacctttaaagcgttcgcggacgaattagaagagaatttgaaggcgggtatctacgcctttaaaggtgcggaaaaaacgcgctttcaatgggaaggtatcgcggtgtggccacatttaggtcacacgtttaaatctatgaagaatctgaattcgattatgaccggtacggcataccccgccctttgggacctgcactatgacgctaacgacgaatctatgcactctatggctgaagcgtacacccgtatttatattaatacttgtctgcagaacaaagtagaggtcctgcttgggatcatggaaaaaggccaggtggatggtaccgtatatcatctgaatcgcagctgcaaactgatgagtttcctgaacgtggaaacggctgaaattattaaagagaagaacggtcttccttacgtctccattgatggcgatcagaccgatcctcgcgttttttctccggcccagtttgatacccgtgttcaggccctggttgagatgatggaggccaatatggcggcagcggaataataagaaggagatatacatatgtcacgcgtggaggcaatcctgtcgcagctgaaagatgtcgccgcgaatccgaaaaaagccatggatgactataaagctgaaacaggtaagggcgcggttggtatcatgccgatctacagccccgaagaaatggtacacgccgctggctatttgccgatgggaatctggggcgcccagggcaaaacgattagtaaagcgcgcacctatctgcctgcttttgcctgcagcgtaatgcagcaggttatggaattacagtgcgagggcgcgtatgatgacctgtccgcagttatttttagcgtaccgtgcgacactctcaaatgtcttagccagaaatggaaaggtacgtccccagtgattgtatttacgcatccgcagaaccgcggattagaagcggcgaaccaattcttggttaccgagtatgaactggtaaaagcacaactggaatcagttctgggtgtgaaaatttcaaacgccgccctggaaaattcgattgcaatttataacgagaatcgtgccgtgatgcgtgagttcgtgaaagtggcagcggactatcctcaagtcattgacgcagtgagccgccacgcggtttttaaagcgcgccagtttatgcttaaggaaaaacataccgcacttgtgaaagaactgatcgctgagattaaagcaacgccagtccagccgtgggacggaaaaaaggttgtagtgacgggcattctgttggaaccgaatgagttattagatatctttaatgagtttaagatcgcgattgttgatgatgatttagcgcaggaaagccgtcggatccgtgttgacgttctggacggagaaggcggaccgctctaccgtatggctaaagcgtggcagcaaatgtatggctgctcgctggcaaccgacaccaagaagggtcgcggccgtatgttaattaacaaaacgattcagaccggtgcggacgctatcgtagttgcaatgatgaagttttgcgacccagaagaatgggattatccggtaatgtaccgtgaatttgaagaaaaaggggtcaaatcacttatgattgaggtggatcaggaagtatcgtctttcgaacagattaaaacccgtctgcagtcattcgtcgaaatgctttaataagaaggagatatacatatgtataccttggggattgatgtcggttctgcctctagtaaagcggtgattctgaaagatggaaaagatattgtcgctgccgaggttgtccaagtcggtaccggctcctcgggtccccaacgcgcactggacaaagcctttgaagtctctggcttaaaaaaggaagacatcagctacacagtagctacgggctatgggcgcttcaattttagcgacgcggataaacagatttcggaaattagctgtcatgccaaaggcatttatttcttagtaccaactgcgcgcactattattgacattggcggccaagatgcgaaagccatccgcctggacgacaaggggggtattaagcaattcttcatgaatgataaatgcgcggcgggcacggggcgtttcctggaagtcatggctcgcgtacttgaaaccaccctggatgaaatggctgaactggatgaacaggcgactgacaccgctcccatttcaagcacctgcacggttttcgccgaaagcgaagtaattagccaattgagcaatggtgtctcacgcaacaacatcattaaaggtgtccatctgagcgttgcgtcacgtgcgtgtggtctggcgtatcgcggcggtttggagaaagatgttgttatgacaggtggcgtggcaaaaaatgcaggggtggtgcgcgcggtggcgggcgttctgaagaccgatgttatcgttgctccgaatcctcagacgaccggtgcactgggggcagcgctgtatgcttatgaggccgcccagaagaagtagatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttt

SEQ ID NO: 222 - DNA, 5829 bp, Artificial Sequence
  source: /note="Description of Artificial Sequence: Synthetic polynucleotide"
atgcgtgcggtactgatcgagaagtccgatgatacacagtccgtctctgtcaccgaactggctgaagatcaactgccggaaggcgacgttttggtagatgttgcttattcaacactgaactacaaagacgccctggcaattaccggtaaagcccccgtcgttcgtcgttttccgatggtacctggaatcgactttacgggtaccgtggcccagtcttcccacgccgacttcaagccaggtgatcgcgtaatcctgaatggttggggtgtgggggaaaaacattggggcggtttagcggagcgcgctcgcgtgcgcggagactggcttgttcccttgccagcccccctggacttacgccaagcggccatgatcggtacagcaggatacacggcgatgttgtgcgttctggcgcttgaacgtcacggagtggtgccgggtaatggggaaatcgtggtgtccggtgcagcaggcggcgtcggctccgttgcgacgacccttcttgccgctaagggctatgaggtagcggcagtgactggacgtgcgtccgaagcagaatatctgcgcggtttgggggcggcgagcgtaattgatcgtaacgaattaacggggaaggtacgcccgctgggtcaggagcgttgggctggcgggattgacgtggcgggatcaaccgtgcttgcgaacatgctttctatgatgaagtatcgcggggtagtcgctgcgtgtggcctggccgcgggcatggatctgcccgcgtctgtcgcgccctttattcttcgtgggatgacgctggcaggggtggatagcgttatgtgcccaaagacagatcgtttagcagcgtgggcccgtttggcgtcagatcttgaccctgccaagctggaggagatgactacagagttgccgtttagtgaagtaatcgagacagcacccaaattcttggacgggacggttcgtggccgcattgttatccccgtaacgccctaagaactctagaaataattttgtttaactttaagaaggagatatacatatgcgcaaagtgccgattatcacggctgacgaggccgcaaaactgatcaaggacggcgacaccgtgacaactagcggctttgtgggtaacgcgatccctgaggcccttgaccgtgcagtcgaaaagcgtttcctggaaacgggcgaaccgaagaacattacttatgtatattgcggcagtcagggcaatcgcgacggtcgtggcgcagaacatttcgcgcatgaaggcctgctgaaacgttatatcgctggccattgggcgaccgtcccggcgttagggaaaatggccatggagaataaaatggaggcctacaatgtctctcagggcgccttgtgtcatctctttcgcgatattgcgagccataaaccgggtgtgttcacgaaagtaggaatcggcaccttcattgatccacgtaacggtggtgggaaggtcaacgatattaccaaggaagatatcgtagaactggtggaaattaaagggcaggaatacctgttttatccggcgttcccgatccatgtcgcgctgattcgtggcacctatgcggacgagagtggtaacatcacctttgaaaaagaggtagcgcctttggaagggacttctgtctgtcaagcggtgaagaactcgggtggcattgtcgtggttcaggttgagcgtgtcgtcaaagcaggcacgctggatccgcgccatgtgaaagttccgggtatctatgtagattacgtagtcgtcgcggatccggaggaccatcaacagtcccttgactgcgaatatgatcctgcccttagtggagagcaccgtcgtccggaggtggtgggtgaaccactgcctttatccgcgaagaaagtcatcggccgccgtggcgcgattgagctcgagaaagacgttgcagtgaaccttggggtaggtgcacctgagtatgtggcctccgtggccgatgaagaaggcattgtggattttatgactctcacagcggagtccggcgctatcggtggcgttccagccggcggtgttcgctttggggcgagctacaatgctgacgccttgatcgaccagggctaccaatttgattattacgacggtgggggtctggatctttgttacctgggtttagctgaatgcgacgaaaagggtaatatcaatgttagccgcttcggtcctcgtatcgctgggtgcggcggattcattaacattacccaaaacacgccgaaagtcttcttttgtgggacctttacagccggggggctgaaagtgaaaattgaagatggtaaggtgattatcgttcaggaagggaaacagaagaaattccttaaggcagtggagcaaatcacctttaatggagacgtggccttagcgaacaagcaacaagttacctacatcacggagcgttgcgtcttcctcctcaaagaagacggtttacacctttcggaaatcgcgccaggcatcgatctgcagacccagattttggatgttatggactttgccccgatcattgatcgtgacgcaaacgggcagattaaactgatggacgcggcgttattcgcagaagggctgatgggcttgaaagaaatgaagtcttgataagaaggagatatacatatgagcttaacccaaggcatgaaagctaaacaactgttagcatactttcagggtaaagccgatcaggatgcacgtgaagcgaaagcccgcggtgagctggtctgctggtcggcgtcagtcgcgccgccggaattttgcgtaacaatgggcattgccatgatctacccggagactcatgcagcgggcatcggtgcccgcaaaggtgcgatggacatgctggaagttgcggaccgcaaaggctacaacgtggattgttgttcctacggccgtgtaaatatgggttacatggaatgtttaaaagaagccgccatcacgggcgtcaagccggaagttttggttaattcccctgctgctgacgttccgcttcccgatttggtgattacgtgtaataatatctgtaacacgctgctgaaatggtacgaaaacttagcagcagaactcgatattccttgcatcgtgatcgacgtaccgtttaatcataccatgccgattccggaatatgccaaggcctacatcgcggaccagttccgcaatgcaatttctcagctggaagttatttgtggccgtccgttcgattggaagaaatttaaggaggtcaaagatcagacccagcgtagcgtataccactggaaccgcattgccgagatggcgaaatacaagcctagcccgctgaacggcttcgatctgttcaattacatggcgttaatcgtggcgtgccgcagcctggattatgcagaaattacctttaaagcgttcgcggacgaattagaagagaatttgaaggcgggtatctacgcctttaaaggtgcggaaaaaacgcgctttcaatgggaaggtatcgcggtgtggccacatttaggtcacacgtttaaatctatgaagaatctgaattcgattatgaccggtacggcataccccgccctttgggacctgcactatgacgctaacgacgaatctatgcactctatggctgaagcgtacacccgtatttatattaatacttgtctgcagaacaaagtagaggtcctgcttgggatcatggaaaaaggccaggtggatggtaccgtatatcatctgaatcgcagctgcaaactgatgagtttcctgaacgtggaaacggctgaaattattaaagagaagaacggtcttccttacgtctccattgatggcgatcagaccgatcctcgcgttttttctccggcccagtttgatacccgtgttcaggccctggttgagatgatggaggccaatatggcggcagcggaataataagaaggagatatacatatgtcacgcgtggaggcaatcctgtcgcagctgaaagatgtcgccgcgaatccgaaaaaagccatggatgactataaagctgaaacaggtaagggcgcggttggtatcatgccgatctacagccccgaagaaatggtacacgccgctggctatttgccgatgggaatctggggcgcccagggcaaaacgattagtaaagcgcgcacctatctgcctgcttttgcctgcagcgtaatgcagcaggttatggaattacagtgcgagggcgcgtatgatgacctgtccgcagttatttttagcgtaccgtgcgacactctcaaatgtcttagccagaaatggaaaggtacgtccccagtgattgtatttacgcatccgcagaaccgcggattagaagcggcgaaccaattcttggttaccgagtatgaactggtaaaagcacaactggaatcagttctgggtgtgaaaatttcaaacgccgccctggaaaattcgattgcaatttataacgagaatcgtgccgtgatgcgtgagttcgtgaaagtggcagcggactatcctcaagtcattgacgcagtgagccgccacgcggtttttaaagcgcgccagtttatgcttaaggaaaaacataccgcacttgtgaaagaactgatcgctgagattaaagcaacgccagtccagccgtgggacggaaaaaaggttgtagtgacgggcattctgttggaaccgaatgagttattagatatctttaatgagtttaagatcgcgattgttgatgatgatttagcgcaggaaagccgtcggatccgtgttgacgttctggacggagaaggcggaccgctctaccgtatggctaaagcgtggcagcaaatgtatggctgctcgctggcaaccgacaccaagaagggtcgcggccgtatgttaattaacaaaacgattcagaccggtgcggacgctatcgtagttgcaatgatgaagttttgcgacccagaagaatgggattatccggtaatgtaccgtgaatttgaagaaaaaggggtcaaatcacttatgattgaggtggatcaggaagtatcgtctttcgaacagattaaaacccgtctgcagtcattcgtcgaaatgctttaataagaaggagatatacatatgtataccttggggattgatgtcggttctgcctctagtaaagcggtgattctgaaagatggaaaagatattgtcgctgccgaggttgtccaagtcggtaccggctcctcgggtccccaacgcgcactggacaaagcctttgaagtctctggcttaaaaaaggaagacatcagctacacagtagctacgggctatgggcgcttcaattttagcgacgcggataaacagatttcggaaattagctgtcatgccaaaggcatttatttcttagtaccaactgcgcgcactattattgacattggcggccaagatgcgaaagccatccgcctggacgacaaggggggtattaagcaattcttcatgaatgataaatgcgcggcgggcacggggcgtttcctggaagtcatggctcgcgtacttgaaaccaccctggatgaaatggctgaactggatgaacaggcgactgacaccgctcccatttcaagcacctgcacggttttcgccgaaagcgaagtaattagccaattgagcaatggtgtctcacgcaacaacatcattaaaggtgtccatctgagcgttgcgtcacgtgcgtgtggtctggcgtatcgcggcggtttggagaaagatgttgttatgacaggtggcgtggcaaaaaatgcaggggtggtgcgcgcggtggcgggcgttctgaagaccgatgttatcgttgctccgaatcctcagacgaccggtgcactgggggcagcgctgtatgcttatgaggccgcccagaagaagta

SEQ ID NO: 223 - DNA, 184 bp, Artificial Sequence
  source: /note="Description of Artificial Sequence: Synthetic polynucleotide"
ttaaccacgacctttaaccagccaagcaataaactctttcgcagcctggccctccaaatagctagaaacatcagaagtgaaagttccctccgcgtggcgttcgaactcgtccatattacctcctgactgtgtctacttcgttgattacgttttgggtttccacccgtcggctcaatcgccgtca

SEQ ID NO: 224 - DNA, 114 bp, Artificial Sequence
  source: /note="Description of Artificial Sequence: Synthetic polynucleotide"
ttaaccacgacctttaaccagccaagcaataaactctttcgcagcctggccctccaaatagctagaaacatcagaagtgaaagttccctccgcgtggcgttcgaactcgtccat

SEQ ID NO: 225 - DNA, 70 bp, Artificial Sequence
  source: /note="Description of Artificial Sequence: Synthetic oligonucleotide"
attacctcctgactgtgtctacttcgttgattacgttttgggtttccacccgtcggctcaatcgccgtca

SEQ ID NO: 226 - DNA, 25 bp, Artificial Sequence
  source: /note="Description of Artificial Sequence: Synthetic oligonucleotide"
attacctcctgactgtgtctacttc

SEQ ID NO: 227 - DNA, 40 bp, Artificial Sequence
  source: /note="Description of Artificial Sequence: Synthetic oligonucleotide"
gggcagaaaaaaccccgccgttggcggggaagcacgttgc

SEQ ID NO: 228 - DNA, 3383 bp, Artificial Sequence
  source: /note="Description of Artificial Sequence: Synthetic polynucleotide"
ggtaccgtcagcataacaccctgacctctcattaattgttcatgccgggcggcactatcgtcgtccggccttttcctctcttactctgctacgtacatctatttctataaatccgttcaatttgtctgttttttgcacaaacatgaaatatcagacaattccgtgacttaagaaaatttatacaaatcagcaatataccccttaaggagtatataaaggtgaatttgatttacatcaataagcggggttgctgaatcgttaaggtaggcggtaatagaaaagaaatcgaggcaaaaatgagcaaagtcagactcgcaattatggatcctctggccgtcgtattacaacgtcgtgactgggaaaaccctggcgttacccaacttaatcgccttgcggcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgacgccgatactgtcgtcgtcccctcaaactggcagatgcacggttacgatgcgcctatctacaccaacgtgacctatcccattacggtcaatccgccgtttgttcccgcggagaatccgacaggttgttactcgctcacatttaatattgatgaaagctggctacaggaaggccagacgcgaattatttttgatggcgttaactcggcgtttcatctgtggtgcaacgggcgctgggtcggttacggccaggacagccgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgaccacgcaaatcagcgatttccaagttaccactctctttaatgatgatttcagccgcgcggtactggaggcagaagttcagatgtacggcgagctgcgcgatgaactgcgggtgacggtttctttgtggcagggtgaaacgcaggtcgccagcggcaccgcgcctttcggcggtgaaattatcgatgagcgtggcggttatgccgatcgcgtcacactacgcctgaacgttgaaaatccggaactgtggagcgccgaaatcccgaatctctatcgtgcagtggttgaactgcacaccgccgacggcacgctgattgaagcagaagcctgcgacgtcggtttccgcgaggtgcggattgaaaatggtctgctgctgctgaacggcaagccgttgctgattcgcggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctacccgcgatgagcgaacgcgtaacgcggatggtgcagcgcgatcgtaatcacccgagtgtgatcatctggtcgctggggaatgaatcaggccacggcgctaatcacgacgcgctgtatcgctggatcaaatctgtcgatccttcccgcccggtacagtatgaaggcggcggagccgacaccacggccaccgatattatttgcccgatgtacgcgcgcgtggatgaagaccagcccttcccggcggtgccgaaatggtccatcaaaaaatggctttcgctgcctggagaaatgcgcccgctgatcctttgcgaatatgcccacgcgatgggtaacagtcttggcggcttcgctaaatactggcaggcgtttcgtcagtacccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccggcgctgacggaagcaaaacaccaacagcagtatttccagttccgtttatccgggcgaaccatcgaagtgaccagcgaatacctgttccgtcatagcgataacgagttcctgcactggatggtggcactggatggcaagccgctggcaagcggtgaagtgcctctggatgttggcccgcaaggtaagcagttgattgaactgcctgaactgccgcagccggagagcgccggacaactctggctaacggtacgcgtagtgcaaccaaacgcgaccgcatggtcagaagccggacacatcagcgcctggcagcaatggcgtctggcggaaaacctcagcgtgacactcccctccgcgtcccacgccatccctcaactgaccaccagcggaacggatttttgcatcgagctgggtaataagcgttggcaatttaaccgccagtcaggctttctttcacagatgtggattggcgatgaaaaacaactgctgaccccgctgcgcgatcagttcacccgtgcgccgctggataacgacattggcgtaagtgaagcgacccgcattgaccctaacgcctgggtcgaacgctggaaggcggcgggccattaccaggccgaagcggcgttgttgcagtgcacggcagatacacttgccgacgcggtgctgattacaaccgcccacgcgtggcagcatcaggggaaaaccttatttatcagccggaaaacctaccggattgatgggcacggtgagatggtcatcaatgtggatgttgcggtggcaagcgatacaccgcatccggcgcggattggcctgacctgccagctggcgcaggtctcagagcgggtaaactggctcggcctggggccgcaagaaaactatcccgaccgccttactgcagcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagccaacaacaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataa

SEQ ID NO: 229 - DNA, 3258 bp, Artificial Sequence
  source: /note="Description of Artificial Sequence: Synthetic polynucleotide"
ggtacccatttcctctcatcccatccggggtgagagtcttttcccccgacttatggctcatgcatgcatcaaaaaagatgtgagcttgatcaaaaacaaaaaatatttcactcgacaggagtatttatattgcgcccgttacgtgggcttcgactgtaaatcagaaaggagaaaacacctatgacgacctacgatcgggatcctctggccgtcgtattacaacgtcgtgactgggaaaaccctggcgttacccaacttaatcgccttgcggcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgacgccgatactgtcgtcgtcccctcaaactggcagatgcacggttacgatgcgcctatctacaccaacgtgacctatcccattacggtcaatccgccgtttgttcccgcggagaatccgacaggttgttactcgctcacatttaatattgatgaaagctggctacaggaaggccagacgcgaattatttttgatggcgttaactcggcgtttcatctgtggtgcaacgggcgctgggtcggttacggccaggacagccgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgaccacgcaaatcagcgatttccaagttaccactctctttaatgatgatttcagccgcgcggtactggaggcagaagttcagatgtacggcgagctgcgcgatgaactgcgggtgacggtttctttgtggcagggtgaaacgcaggtcgccagcggcaccgcgcctttcggcggtgaaattatcgatgagcgtggcggttatgccgatcgcgtcacactacgcctgaacgttgaaaatccggaactgtggagcgccgaaatcccgaatctctatcgtgcagtggttgaactgcacaccgccgacggcacgctgattgaagcagaagcctgcgacgtcggtttccgcgaggtgcggattgaaaatggtctgctgctgctgaacggcaagccgttgctgattcgcggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctacccgcgatgagcgaacgcgtaacgcggatggtgcagcgcgatcgtaatcacccgagtgtgatcatctggtcgctggggaatgaatcaggccacggcgctaatcacgacgcgctgtatcgctggatcaaatctgtcgatccttcccgcccggtacagtatgaaggcggcggagccgacaccacggccaccgatattatttgcccgatgtacgcgcgcgtggatgaagaccagcccttcccggcggtgccgaaatggtccatcaaaaaatggctttcgctgcctggagaaatgcgcccgctgatcctttgcgaatatgcccacgcgatgggtaacagtcttggcggcttcgctaaatactggcaggcgtttcgtcagtacccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccggcgctgacggaagcaaaacaccaacagcagtatttccagttccgtttatccgggcgaaccatcgaagtgaccagcgaatacctgttccgtcatagcgataacgagttcctgcactggatggtggcactggatggcaagccgctggcaagcggtgaagtgcctctggatgttggcccgcaaggtaagcagttgattgaactgcctgaactgccgcagccggagagcgccggacaactctggctaacggtacgcgtagtgcaaccaaacgcgaccgcatggtcagaagccggacacatcagcgcctggcagcaatggcgtctggcggaaaacctcagcgtgacactcccctccgcgtcccacgccatccctcaactgaccaccagcggaacggatttttgcatcgagctgggtaataagcgttggcaatttaaccgccagtcaggctttctttcacagatgtggattggcgatgaaaaacaactgctgaccccgctgcgcgatcagttcacccgtgcgccgctggataacgacattggcgtaagtgaagcgacccgcattgaccctaacgcctgggtcgaacgctggaaggcggcgggccattaccaggccgaagcggcgttgttgcagtgcacggcagatacacttgccgacgcggtgctgattacaaccgcccacgcgtggcagcatcaggggaaaaccttatttatcagccggaaaacctaccggattgatgggcacggtgagatggtcatcaatgtggatgttgcggtggcaagcgatacaccgcatccggcgcggattggcctgacctgccagctggcgcaggtctcagagcgggtaaactggctcggcctggggccgcaagaaaactatcccgaccgccttactgcagcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagccaacaacaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataa

SEQ ID NO: 230 - DNA, 3386 bp, Artificial Sequence
  source: /note="Description of Artificial Sequence: Synthetic polynucleotide"
ggtaccgtcagcataacaccctgacctctcattaattgttcatgccgggcggcactatcgtcgtccggccttttcctctcttactctgctacgtacatctatttctataaatccgttcaatttgtctgttttttgcacaaacatgaaatatcagacaattccgtgacttaagaaaatttatacaaatcagcaatataccccttaaggagtatataaaggtgaatttgatttacatcaataagcggggttgctgaatcgttaaggatccctctagaaataattttgtttaactttaagaaggagatatacatatgactatgattacggattctctggccgtcgtattacaacgtcgtgactgggaaaaccctggcgttacccaacttaatcgccttgcggcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgacgccgatactgtcgtcgtcccctcaaactggcagatgcacggttacgatgcgcctatctacaccaacgtgacctatcccattacggtcaatccgccgtttgttcccgcggagaatccgacaggttgttactcgctcacatttaatattgatgaaagctggctacaggaaggccagacgcgaattatttttgatggcgttaactcggcgtttcatctgtggtgcaacgggcgctgggtcggttacggccaggacagccgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgaccacgcaaatcagcgatttccaagttaccactctctttaatgatgatttcagccgcgcggtactggaggcagaagttcagatgtacggcgagctgcgcgatgaactgcgggtgacggtttctttgtggcagggtgaaacgcaggtcgccagcggcaccgcgcctttcggcggtgaaattatcgatgagcgtggcggttatgccgatcgcgtcacactacgcctgaacgttgaaaatccggaactgtggagcgccgaaatcccgaatctctatcgtgcagtggttgaactgcacaccgccgacggcacgctgattgaagcagaagcctgcgacgtcggtttccgcgaggtgcggattgaaaatggtctgctgctgctgaacggcaagccgttgctgattcgcggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctacccgcgatgagcgaacgcgtaacgcggatggtgcagcgcgatcgtaatcacccgagtgtgatcatctggtcgctggggaatgaatcaggccacggcgctaatcacgacgcgctgtatcgctggatcaaatctgtcgatccttcccgcccggtacagtatgaaggcggcggagccgacaccacggccaccgatattatttgcccgatgtacgcgcgcgtggatgaagaccagcccttcccggcggtgccgaaatggtccatcaaaaaatggctttcgctgcctggagaaatgcgcccgctgatcctttgcgaatatgcccacgcgatgggtaacagtcttggcggcttcgctaaatactggcaggcgtttcgtcagtacccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccggcgctgacggaagcaaaacaccaacagcagtatttccagttccgtttatccgggcgaaccatcgaagtgaccagcgaatacctgttccgtcatagcgataacgagttcctgcactggatggtggcactggatggcaagccgctggcaagcggtgaagtgcctctggatgttggcccgcaaggtaagcagttgattgaactgcctgaactgccgcagccggagagcgccggacaactctggctaacggtacgcgtagtgcaaccaaacgcgaccgcatggtcagaagccggacacatcagcgcctggcagcaatggcgtctggcggaaaacctcagcgtgacactcccctccgcgtcccacgccatccctcaactgaccaccagcggaacggatttttgcatcgagctgggtaataagcgttggcaatttaaccgccagtcaggctttctttcacagatgtggattggcgatgaaaaacaactgctgaccccgctgcgcgatcagttcacccgtgcgccgctggataacgacattggcgtaagtgaagcgacccgcattgaccctaacgcctgggtcgaacgctggaaggcggcgggccattaccaggccgaagcggcgttgttgcagtgcacggcagatacacttgccgacgcggtgctgattacaaccgcccacgcgtggcagcatcaggggaaaaccttatttatcagccggaaaacctaccggattgatgggcacggtgagatggtcatcaatgtggatgttgcggtggcaagcgatacaccgcatccggcgcggattggcctgacctgccagctggcgcaggtctcagagcgggtaaactggctcggcctggggccgcaagaaaactatcccgaccgccttactgcagcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagccaacaacaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataa

SEQ ID NO: 231 - DNA, 3261 bp, Artificial Sequence
  source: /note="Description of Artificial Sequence: Synthetic polynucleotide"
ggtacccatttcctctcatcccatccggggtgagagtcttttcccccgacttatggctcatgcatgcatcaaaaaagatgtgagcttgatcaaaaacaaaaaatatttcactcgacaggagtatttatattgcgcccggatccctctagaaataattttgtttaactttaagaaggagatatacatatgactatgattacggattctctggccgtcgtattacaacgtcgtgactgggaaaaccctggcgttacccaacttaatcgccttgcggcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgacgccgatactgtcgtcgtcccctcaaactggcagatgcacggttacgatgcgcctatctacaccaacgtgacctatcccattacggtcaatccgccgtttgttcccgcggagaatccgacaggttgttactcgctcacatttaatattgatgaaagctggctacaggaaggccagacgcgaattatttttgatggcgttaactcggcgtttcatctgtggtgcaacgggcgctgggtcggttacggccaggacagccgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgaccacgcaaatcagcgatttccaagttaccactctctttaatgatgatttcagccgcgcggtactggaggcagaagttcagatgtacggcgagctgcgcgatgaactgcgggtgacggtttctttgtggcagggtgaaacgcaggtcgccagcggcaccgcgcctttcggcggtgaaattatcgatgagcgtggcggttatgccgatcgcgtcacactacgcctgaacgttgaaaatccggaactgtggagcgccgaaatcccgaatctctatcgtgcagtggttgaactgcacaccgccgacggcacgctgattgaagcagaagcctgcgacgtcggtttccgcgaggtgcggattgaaaatggtctgctgctgctgaacggcaagccgttgctgattcgcggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctacccgcgatgagcgaacgcgtaacgcggatggtgcagcgcgatcgtaatcacccgagtgtgatcatctggtcgctggggaatgaatcaggccacggcgctaatcacgacgcgctgtatcgctggatcaaatctgtcgatccttcccgcccggtacagtatgaaggcggcggagccgacaccacggccaccgatattatttgcccgatgtacgcgcgcgtggatgaagaccagcccttcccggcggtgccgaaatggtccatcaaaaaatggctttcgctgcctggagaaatgcgcccgctgatcctttgcgaatatgcccacgcgatgggtaacagtcttggcggcttcgctaaatactggcaggcgtttcgtcagtacccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccggcgctgacggaagcaaaacaccaacagcagtatttccagttccgtttatccgggcgaaccatcgaagtgaccagcgaatacctgttccgtcatagcgataacgagttcctgcactggatggtggcactggatggcaagccgctggcaagcggtgaagtgcctctggatgttggcccgcaaggtaagcagttgattgaactgcctgaactgccgcagccggagagcgccggacaactctggctaacggtacgcgtagtgcaaccaaacgcgaccgcatggtcagaagccggacacatcagcgcctggcagcaatggcgtctggcggaaaacctcagcgtgacactcccctccgcgtcccacgccatccctcaactgaccaccagcggaacggatttttgcatcgagctgggtaataagcgttggcaatttaaccgccagtcaggctttctttcacagatgtggattggcgatgaaaaacaactgctgaccccgctgcgcgatcagttcacccgtgcgccgctggataacgacattggcgtaagtgaagcgacccgcattgaccctaacgcctgggtcgaacgctggaaggcggcgggccattaccaggccgaagcggcgttgttgcagtgcacggcagatacacttgccgacgcggtgctgattacaaccgcccacgcgtggcagcatcaggggaaaaccttatttatcagccggaaaacctaccggattgatgggcacggtgagatggtcatcaatgtggatgttgcggtggcaagcgatacaccgcatccggcgcggattggcctgacctgccagctggcgcaggtctcagagcgggtaaactggctcggcctggggccgcaagaaaactatcccgaccgccttactgcagcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagccaacaacaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataa

SEQ ID NO: 232 - DNA, 3279 bp, Artificial Sequence
  source: /note="Description of Artificial Sequence: Synthetic polynucleotide"
ggtaccagttgttcttattggtggtgttgctttatggttgcatcgtagtaaatggttgtaacaaaagcaatttttccggctgtctgtatacaaaaacgccgtaaagtttgagcgaagtcaataaactctctacccattcagggcaatatctctcttggatccctctagaaataattttgtttaactttaagaaggagatatacatatgctatgattacggattctctggccgtcgtattacaacgtcgtgactgggaaaaccctggcgttacccaacttaatcgccttgcggcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgacgccgatactgtcgtcgtcccctcaaactggcagatgcacggttacgatgcgcctatctacaccaacgtgacctatcccattacggtcaatccgccgtttgttcccgcggagaatccgacaggttgttactcgctcacatttaatattgatgaaagctggctacaggaaggccagacgcgaattatttttgatggcgttaactcggcgtttcatctgtggtgcaacgggcgctgggtcggttacggccaggacagccgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgaccacgcaaatcagcgatttccaagttaccactctctttaatgatgatttcagccgcgcggtactggaggcagaagttcagatgtacggcgagctgcgcgatgaactgcgggtgacggtttctttgtggcagggtgaaacgcaggtcgccagcggcaccgcgcctttcggcggtgaaattatcgatgagcgtggcggttatgccgatcgcgtcacactacgcctgaacgttgaaaatccggaactgtggagcgccgaaatcccgaatctctatcgtgcagtggttgaactgcacaccgccgacggcacgctgattgaagcagaagcctgcgacgtcggtttccgcgaggtgcggattgaaaatggtctgctgctgctgaacggcaagccgttgctgattcgcggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctacccgcgatgagcgaacgcgtaacgcggatggtgcagcgcgatcgtaatcacccgagtgtgatcatctggtcgctggggaatgaatcaggccacggcgctaatcacgacgcgctgtatcgctggatcaaatctgtcgatccttcccgcccggtacagtatgaaggcggcggagccgacaccacggccaccgatattatttgcccgatgtacgcgcgcgtggatgaagaccagcccttcccggcggtgccgaaatggtccatcaaaaaatggctttcgctgcctggagaaatgcgcccgctgatcctttgcgaatatgcccacgcgatgggtaacagtcttggcggcttcgctaaatactggcaggcgtttcgtcagtacccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccggcgctgacggaagcaaaacaccaacagcagtatttccagttccgtttatccgggcgaaccatcgaagtgaccagcgaatacctgttccgtcatagcgataacgagttcctgcactggatggtggcactggatggcaagccgctggcaagcggtgaagtgcctctggatgttggcccgcaaggtaagcagttgattgaactgcctgaactgccgcagccggagagcgccggacaactctggctaacggtacgcgtagtgcaaccaaacgcgaccgcatggtcagaagccggacacatcagcgcctggcagcaatggcgtctggcggaaaacctcagcgtgacactcccctccgcgtcccacgccatccctcaactgaccaccagcggaacggatttttgcatcgagctgggtaataagcgttggcaatttaaccgccagtcaggctttctttcacagatgtggattggcgatgaaaaacaactgctgaccccgctgcgcgatcagttcacccgtgcgccgctggataacgacattggcgtaagtgaagcgacccgcattgaccctaacgcctgggtcgaacgctggaaggcggcgggccattaccaggccgaagcggcgttgttgcagtgcacggcagatacacttgccgacgcggtgctgattacaaccgcccacgcgtggcagcatcaggggaaaaccttatttatcagccggaaaacctaccggattgatgggcacggtgagatggtcatcaatgtggatgttgcggtggcaagcgatacaccgcatccggcgcggattggcctgacctgccagctggcgcaggtctcagagcgggtaaactggctcggcctggggccgcaagaaaactatcccgaccgccttactgcagcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagccaacaacaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataa

SEQ ID NO: 233 - DNA, 967 bp, Unknown
  source: /note="Description of Unknown: Wild-type clbA polynucleotide"
caaatatcacataatcttaacatatcaataaacacagtaaagtttcatgtgaaaaacatcaaacataaaatacaagctcggaatacgaatcacgctatacacattgctaacaggaatgagattatctaaatgaggattgatatattaattggacatactagtttttttcatcaaaccagtagagataacttccttcactatctcaatgaggaagaaataaaacgctatgatcagtttcattttgtgagtgataaagaactctatattttaagccgtatcctgctcaaaacagcactaaaaagatatcaacctgatgtctcattacaatcatggcaatttagtacgtgcaaatatggcaaaccatttatagtttttcctcagttggcaaaaaagattttttttaacctttcccatactatagatacagtagccgttgctattagttctcactgcgagcttggtgtcgatattgaacaaataagagatttagacaactcttatctgaatatcagtcagcatttttttactccacaggaagctactaacatagtttcacttcctcgttatgaaggtcaattacttttttggaaaatgtggacgctcaaagaagcttacatcaaatatcgaggtaaaggcctatctttaggactggattgtattgaatttcatttaacaaataaaaaactaacttcaaaatatagaggttcacctgtttatttctctcaatggaaaatatgtaactcatttctcgcattagcctctccactcatcacccctaaaataactattgagctatttcctatgcagtcccaactttatcaccacgactatcagctaattcattcgtcaaatgggcagaattgaatcgccacggataatctagacacttctgagccgtcgataatattgattttcatattccgtcggtggtgtaagtatcccgcataatcgtgccattcacatttag

SEQ ID NO: 234 - DNA, 424 bp, Unknown
  source: /note="Description of Unknown: clbA knock-out polynucleotide"
ggatggggggaaacatggataagttcaaagaaaaaaacccgttatctctgcgtgaaagacaagtattgcgcatgctggcacaaggtgatgagtactctcaaatatcacataatcttaacatatcaataaacacagtaaagtttcatgtgaaaaacatcaaacataaaatacaagctcggaatacgaatcacgctatacacattgctaacaggaatgagattatctaaatgaggattgatgtgtaggctggagctgcttcgaagttcctatactttctagagaataggaacttcggaataggaacttcggaataggaactaaggaggatattcatatgtcgtcaaatgggcagaattgaatcgccacggataatctagacacttctgagccgtcgataatattgattttcatattccgtcggtgg

SEQ ID NO: 235 - DNA, 1589 bp, Artificial Sequence
  source: /note="Description of Artificial Sequence: Synthetic polynucleotide"
gggcagaaaaaaccccgccgttggcggggaagcacgttgctggcaaattaccattcatgttgccggatgcggcgtaaacgccttatccggcctacaaaaatgtgcaaattcaataaattgcaattccccttgtaggcctgataagcgcagcgcatcaggcaatttggcgttgccgtcagtctcagttaatcaggttacggcgattaaccacgacctttaaccagccaagcaataaactctttcgcagcctggccctccaaatagctagaaacatcagaagtgaaagttccctccgcgtggcgttcgaactcgtccatattacctcctgactgtgtctacttcgttgattacgttttgggtttccacccgtcggctcaatcgccgtcaaccctgttatcgtctgtcgtaaaacaacctttagaatttttttcacaaacagccattttttgttagtcgacgaaatactcttttctctgccccttattcccgctattaaaaaaaacaattaaacgtaaactttgcgcaattcaggccgataaccccggtattcgttttacgtgtcgaaagataaacgaagttcctatactttctagagaataggaacttcggaataggaacttcatttctcgttcgctgccacctaagaatactctacggtcacatacaaatggcgcgccttacgccccgccctgccactcatcgcagtactgttgtattcattaagcatctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgtaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacaactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtaggcgcgccgaagttcctatactttctagagaataggaacttcggaataggaact

SEQ ID NO: 236 - DNA, 18 bp, Artificial Sequence
  source: /note="Description of Artificial Sequence: Synthetic oligonucleotide"
ttgttgayryrtcaacwa

SEQ ID NO: 237 - DNA, 15 bp, Artificial Sequence
  source: /note="Description of Artificial Sequence: Synthetic oligonucleotide"
  modified_base (8)..(8): a, c, t, g, unknown or other
ttataatnattataa

SEQ ID NO: 238 - protein, 6 aa, Artificial Sequence
  source: /note="Description of Artificial Sequence: Synthetic peptide"
KKKKKK

SEQ ID NO: 239 - protein, 16 aa, Artificial Sequence
  source: /note="Description of Artificial Sequence: Synthetic peptide"
GGGGSGGGGSGGGGSA

SEQ ID NO: 240 - DNA, 14 bp, Artificial Sequence
  source: /note="Description of Artificial Sequence: Synthetic oligonucleotide"
  modified_base (6)..(9): a, c, t, g, unknown or other
ttgatnnnnatcaa

SEQ ID NO: 241 - DNA, 20 bp, Artificial Sequence
  source: /note="Description of Artificial Sequence: Synthetic oligonucleotide"
atttaatgccggctatctgg

SEQ ID NO: 242 - DNA, 22 bp, Artificial Sequence
  source: /note="Description of Artificial Sequence: Synthetic oligonucleotide"
gctatctgggtttagccctaaa

The invention claimed is:

1. A bacterium comprising a gene cassette that encodes a biosynthetic pathway for producing a short chain fatty acid, wherein the short chain fatty acid is butyrate, propionate, or acetate, and wherein the gene cassette is operably linked to a promoter that is induced by exogenous environmental conditions found in the mammalian gut and that is not associated with the gene cassette in nature, and wherein the bacterium further comprises a gene or gene cassette for producing indole-3-acetic acid or tryptamine.

2. The bacterium of claim 1, wherein the bacterium further comprises a gene or gene cassette for the production of GLP1.

3. The bacterium of claim 1, wherein the promoter is induced by low-oxygen or anaerobic conditions;
    selected from a FNR-inducible promoter, an ANR-inducible promoter, and a DNR-inducible promoter;

regulated by a reactive nitrogen species (RNS); or
regulated by a reactive oxygen species (ROS).

4. The bacterium of claim 3, wherein the promoter is a FNR-inducible promoter.

5. The bacterium of claim 3, wherein the gene cassette and operatively linked promoter are present on a plasmid in the bacterium.

6. The bacterium of claim 3, wherein the gene cassette and operatively linked promoter are present on a chromosome in the bacterium.

7. The bacterium of claim 1, wherein the bacterium is an auxotroph comprising a deletion or mutation in a gene required for cell survival and/or growth.

8. The genetically engineered bacterium of claim 7, wherein the bacterium is an auxotroph in diaminopimelic acid or an enzyme in the thymidine biosynthetic pathway.

9. The bacterium of claim 1, wherein the bacterium comprises a kill switch.

10. The bacterium of claim 1, wherein the bacterium further comprises a second gene encoding a substance toxic to the bacterium, wherein the second gene is under the control of a second promoter that is directly or indirectly induced by an exogenous environmental condition not naturally present in a mammalian gut.

11. The bacterium of claim 1, wherein the bacterium is a non-pathogenic bacterium.

12. The bacterium of claim 1, wherein the bacterium is a probiotic or a commensal bacterium.

13. The bacterium of claim 12, wherein the bacterium is selected from the group consisting of *Bacteroides, Bifidobacterium, Clostridium, Escherichia, Lactobacillus*, and *Lactococcus*.

14. The bacterium of claim 13, wherein the bacterium is *Escherichia coli* strain Nissle.

15. A pharmaceutically acceptable composition comprising the bacterium of claim 1; and a pharmaceutically acceptable carrier.

16. The pharmaceutically acceptable composition of claim 15, wherein the composition is formulated for oral administration.

17. The pharmaceutically acceptable composition of claim 15 or claim 16, wherein the composition is for use in treating a metabolic disease or disorder.

18. The pharmaceutically acceptable composition of claim 17, wherein the metabolic disease or disorder is selected for the group consisting of type 1 diabetes; type 2 diabetes; metabolic syndrome; Bardet-Biedel syndrome; Prader-Willi syndrome; non-alcoholic fatty liver disease; tuberous sclerosis; Albright hereditary osteodystrophy; brain-derived neurotrophic factor (BDNF) deficiency; Single-minded 1 (SIM1) deficiency; leptin deficiency; leptin receptor deficiency; pro-opiomelanocortin (POMC) defects; proprotein convertase subtilisin/kexin type 1 (PCSK1) deficiency; Src homology 2B1 (SH2B1) deficiency; pro-hormone convertase 1/3 deficiency; melanocortin-4-receptor (MC4R) deficiency; Wilms tumor, aniridia, genitourinary anomalies, and mental retardation (WAGR) syndrome; pseudohypoparathyroidism type 1A; Fragile X syndrome; Borjeson-Forsmann-Lehmann syndrome; Alstrom syndrome; Cohen syndrome; and ulnar-mammary syndrome.

19. The pharmaceutically acceptable composition of claim 18, wherein the metabolic disease or disorder is type 1 diabetes or type 2 diabetes.

* * * * *